(12) United States Patent
Eckert et al.

(10) Patent No.: US 8,754,039 B2
(45) Date of Patent: Jun. 17, 2014

(54) TARGETED ANTIMICROBIAL MOIETIES

(75) Inventors: Randal H. Eckert, Redondo Beach, CA (US); Chris Kaplan, Los Angeles, CA (US); Jian He, Los Angeles, CA (US); Daniel K. Yarbrough, Los Angeles, CA (US); Maxwell Anderson, Sequim, WA (US); Jee-Hyun Sim, Garden Grove, CA (US)

(73) Assignee: C3 Jian, Inc., Marina Del Rey, CA (US)

( * ) Notice: Subject to any disclaimer, the term of this patent is extended or adjusted under 35 U.S.C. 154(b) by 616 days.

(21) Appl. No.: 12/683,160

(22) Filed: Jan. 6, 2010

(65) Prior Publication Data

US 2011/0039761 A1 Feb. 17, 2011

Related U.S. Application Data

(60) Provisional application No. 61/142,830, filed on Jan. 6, 2009, provisional application No. 61/151,445, filed on Feb. 10, 2009, provisional application No. 61/243,905, filed on Sep. 18, 2009, provisional application No. 61/243,930, filed on Sep. 18, 2009.

(51) Int. Cl.
*A61K 38/00* (2006.01)
*A61K 38/40* (2006.01)

(52) U.S. Cl.
USPC ............... 514/2.4; 514/2.6; 514/4.5; 530/326

(58) Field of Classification Search
None
See application file for complete search history.

(56) References Cited

U.S. PATENT DOCUMENTS

| | | | |
|---|---|---|---|
| 7,018,637 B2 * | 3/2006 | Chong et al. ............. | 424/197.11 |
| 8,303,962 B2 | 11/2012 | Eckert et al. | |
| 2002/0082195 A1 | 6/2002 | Lehrer et al. | |
| 2002/0156017 A1 | 10/2002 | Hancock et al. | |
| 2002/0166141 A1 | 11/2002 | Simmons et al. | |
| 2003/0105281 A1 | 6/2003 | Noga et al. | |
| 2003/0144184 A1 | 7/2003 | Lehrer et al. | |
| 2003/0148397 A1 | 8/2003 | Leite et al. | |
| 2003/0195150 A1 | 10/2003 | Reynolds et al. | |
| 2004/0033955 A1 | 2/2004 | Catania et al. | |
| 2004/0048792 A1 | 3/2004 | Pereira et al. | |
| 2004/0052814 A1 | 3/2004 | Shi et al. | |
| 2004/0072777 A1 | 4/2004 | Froelich et al. | |
| 2004/0072990 A1 | 4/2004 | Tzeng et al. | |
| 2004/0087771 A1 | 5/2004 | Lamberty et al. | |
| 2004/0235745 A1 | 11/2004 | Deber et al. | |
| 2005/0020813 A1 | 1/2005 | Masignani et al. | |
| 2005/0065072 A1 | 3/2005 | Keeler et al. | |
| 2005/0187151 A1 | 8/2005 | Strom et al. | |
| 2005/0272645 A1 | 12/2005 | Lehrer et al. | |
| 2006/0089488 A1 | 4/2006 | Yoshida et al. | |
| 2006/0122122 A1 | 6/2006 | Kobayashi et al. | |
| 2006/0128614 A1 | 6/2006 | Cheng et al. | |
| 2006/0166883 A1 | 7/2006 | Hu et al. | |
| 2006/0287232 A1 | 12/2006 | Clayberger et al. | |
| 2007/0032431 A1 | 2/2007 | Yoshida et al. | |
| 2007/0178116 A1 | 8/2007 | Adderson et al. | |
| 2007/0231833 A1 | 10/2007 | Arcidiacono et al. | |
| 2007/0244044 A1 | 10/2007 | O'Neil et al. | |
| 2007/0259087 A1 | 11/2007 | Segura et al. | |
| 2008/0069849 A1 | 3/2008 | Schmidtchen et al. | |
| 2008/0125359 A1 | 5/2008 | Wang et al. | |
| 2008/0170991 A1 * | 7/2008 | Shi et al. ....................... | 424/1.69 |
| 2008/0207522 A1 | 8/2008 | Hancock et al. | |
| 2008/0213430 A1 | 9/2008 | Segura et al. | |
| 2008/0234188 A1 | 9/2008 | Deber et al. | |
| 2008/0249022 A1 | 10/2008 | Grote et al. | |
| 2008/0286210 A1 | 11/2008 | He et al. | |
| 2009/0005300 A1 | 1/2009 | Hodges et al. | |
| 2009/0023641 A1 | 1/2009 | O'Neil et al. | |
| 2009/0048167 A1 | 2/2009 | Hillman et al. | |
| 2009/0074864 A1 | 3/2009 | Schmidtchen et al. | |
| 2009/0099533 A1 | 4/2009 | Montelaro et al. | |
| 2009/0143299 A1 | 6/2009 | Schmidtchen et al. | |
| 2009/0156499 A1 | 6/2009 | Wang et al. | |
| 2009/0214498 A1 | 8/2009 | Ross et al. | |
| 2009/0233870 A1 | 9/2009 | Blondelle et al. | |
| 2009/0258045 A1 | 10/2009 | Chuang et al. | |
| 2009/0264344 A1 | 10/2009 | Lehrer et al. | |
| 2009/0312265 A1 | 12/2009 | Schmidtchen et al. | |
| 2010/0143387 A1 * | 6/2010 | Kraehmer et al. ......... | 424/178.1 |
| 2010/0184681 A1 | 7/2010 | Eckert et al. | |
| 2010/0184683 A1 | 7/2010 | Eckert et al. | |
| 2010/0184684 A1 | 7/2010 | Eckert et al. | |
| 2011/0039762 A1 | 2/2011 | Eckert et al. | |
| 2011/0039763 A1 | 2/2011 | Eckert et al. | |
| 2013/0108575 A1 | 5/2013 | Eckert et al. | |

FOREIGN PATENT DOCUMENTS

| | | |
|---|---|---|
| WO | WO 2008/030988 | 3/2008 |
| WO | WO2010/080819 | 7/2010 |
| WO | WO2010/080836 | 7/2010 |

OTHER PUBLICATIONS

Ajdic et al. PNAS 2002.*
PCT International Search Report and Written Opinion dated Mar. 30, 2010 issued in WO2010/080819 [PCT/US2010/020242].
PCT International Preliminary Report on Patentability dated Jul. 12, 2011 issued in WO2010/080819 [PCT/US2010/020242].
US Office Action dated Oct. 20, 2011 issued in U.S. Appl. No.12/683,188.
US Notice of Allowance dated Jul. 3, 2012 issued in U.S. Appl. No. 12/683,188.
Eckert et al. (2006) "Adding Selectivity to Antimicrobial Peptides: Rational Design of a Multidomain Peptide against *Pseudomonas* spp." *Antimicrobial Agents and Chemotherapy*, 50(4): 1480-1488.

(Continued)

*Primary Examiner* — James H Alstrum Acevedo
*Assistant Examiner* — Li Lee
(74) *Attorney, Agent, or Firm* — Tom Hunter; Weaver Austin Villeneuve & Sampson LLP

(57) ABSTRACT

This invention provides novel targeted antimicrobial compositions. In various embodiments chimeric moieties are provided comprising an antimicrobial peptide attached to a peptide targeting moiety that binds a bacterial strain or species.

18 Claims, 19 Drawing Sheets

(56) References Cited

OTHER PUBLICATIONS

Eckert et al. (2006) "Enhancement of Antimicrobial Activity against *Pseudomonas aeruginosa* by Coadministration of G10KHc and Tobramycin" *Antimicrobial Agents and Chemotherapy*, 50(11): 3833-3838.

Eckert et al. (2006) "Targeted Killing of *Streptococcus* mutans by a Pheromone-Guided "Smart" Antimicrobial Peptide" *Antimicrobial Agents and Chemotherapy*, 50(11): 3651-3657.

Eckert et al. (2007) "Stability and Activity in Sputum of G10KHc, a Potent Anti-Pseudomonas Antimicrobial Peptide" *Chem Biol Drug Des*, 70: 456-460.

Franzman (2007) "Targeted antimicrobial activity of SMAP28 conjugated to IgG antibody." Master's thesis, University of Iowa, 1-96 http://ir.uiowa.edu/etd/140.

He et al. (2009) "Design and activity of a 'dual-targeted' antimicrobial peptide" *Int. J. Antimicrobial Agents*, 33(6): 532-537.

He et al. (2010) "Systematic Approach to Optimizing Specifically Targeted Antimicrobial Peptides against *Streptococcus* mutans" *Antimicrobial Agents and Chemotherapy*, 54(4): 2143-2151.

Kaplan et al. (2011) "Selective Membrane Disruption: Mode of Action of C16G2, a Specifically Targeted Antimicrobial Peptide" *Antimicrobial Agents and Chemotherapy*, 55(7): 3446-3452.

Li et al. (2010) "Targeted Antimicrobial Therapy Against *Streptococcus* mutans Establishes Protective Non-cariogenic Oral Biofilms and Reduces Subsequent Infection" *Int J Oral Sci*, 2(2): 66-73.

CN Office Action dated Apr. 11, 2013 issued in 201080011405.5 [with English translation].

* cited by examiner

Formula I

(91) R = —CH(OH)—CH₃
(92) R = V
(93) R = Et
(94) R = —H
(95) R = —COCH₃
(96) R = —CHO
(97) R = —CH(OH)—CH₂OH
(98) R = —CH=CHCO₂H
(99) R = Pᴿ

Pᴿ = CH₂CH₂CO₂R,
R = H, alkyl, alkoxyl, alkenyl or alkynyl,
all from C₁ to C₈, but preferably H
Me = methyl

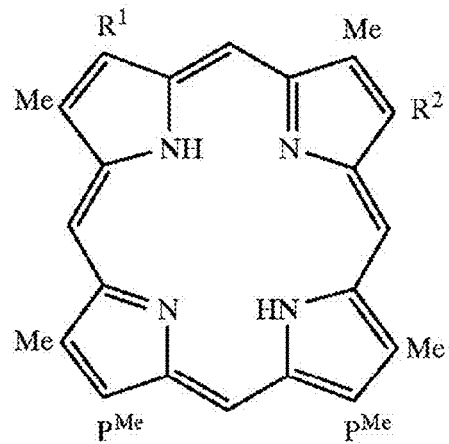

Formula II

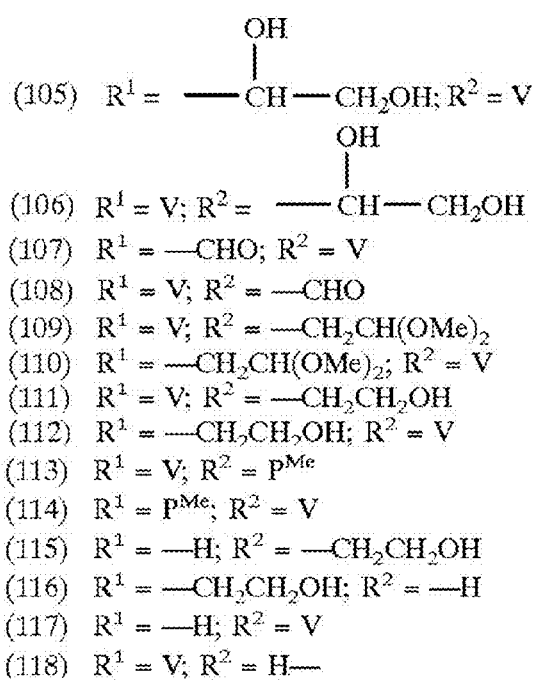

(100) $R^1 = R^2 = -CH_2CH(OMe)_2$
(101) $R^1 = R^2 = -CH_2CH_2OH$
(102) $R^1 = R^2 = -CH_2CH_2Cl$
(103) $R^1 = R^2 = -CH_2CH_2Br$
(104) $R^1 = R^2 = -CH_2CH_2CN$ (105) $R^1 = -CH(OH)-CH_2OH; R^2 = V$
(106) $R^1 = V; R^2 = -CH(OH)-CH_2OH$
(107) $R^1 = -CHO; R^2 = V$
(108) $R^1 = V; R^2 = -CHO$
(109) $R^1 = V; R^2 = -CH_2CH(OMe)_2$
(110) $R^1 = -CH_2CH(OMe)_2; R^2 = V$
(111) $R^1 = V; R^2 = -CH_2CH_2OH$
(112) $R^1 = -CH_2CH_2OH; R^2 = V$
(113) $R^1 = V; R^2 = P^{Me}$
(114) $R^1 = P^{Me}; R^2 = V$
(115) $R^1 = -H; R^2 = -CH_2CH_2OH$
(116) $R^1 = -CH_2CH_2OH; R^2 = -H$
(117) $R^1 = -H; R^2 = V$
(118) $R^1 = V; R^2 = H-$

V = vinyl
Et = ethyl
$P^R = CH_2CH_2CO_2R$,
R = H, alkyl, alkoxyl, alkenyl or alkynyl, all from $C_1$ to $C_8$, but preferably H.
Me = methyl

*Fig. 2*

| Compound | M | X | Y |
|---|---|---|---|
| 119 | 2H | | SO₃H |
| 120 | 2H | | N(CH₃)₃⁺ |
| 121 | HOSiOSiCH₂CH₂N(CH₃)₂ | H | |
| 121, 122, 123 | GaIII/ AlIII/ ZnII | SO₃H / C(CH₃)₃ | |
| 124 | 2H | C(CH₃)₃ | |
| 125 | Zn | CH₂-N⁺(pyridine) | |
| 126 | Zn | SO₂N(CH₂CH₂OH)₂ | |
| 126 | Zn | SO₃H | |

Monastral Fast Blue B
(phthalocyanine)

Monastral Fast Blue G
(CI Pigment Blue 15)

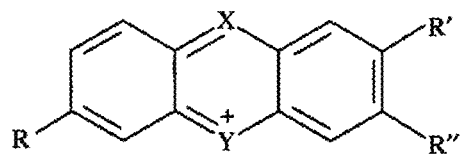
| | R | R" | R' | X | Y |
|---|---|---|---|---|---|
| Methylene blue | $(CH_3)_2N$ | $N(CH_3)_2$ | H | N | S |
| Toluidine blue O | $(CH_3)_2N$ | $NH_2$ | $CH_3$ | N | S |
| Neutral red | $(CH_3)_2N$ | $NH_2$ | $CH_3$ | N | NH |
| Proflavine | $H_2N$ | $NH_2$ | H | CH | NH |
| Acridine orange | $(CH_3)_2N$ | $N(CH_3)_2$ | H | CH | NH |
| Aminacrine | H | H | H | $C-NH_2$ | NH |
| Ethacridine | $H_2N$ | H | $OC_2H_5$ | $C-NH_2$ | NH |
*Fig. 5*
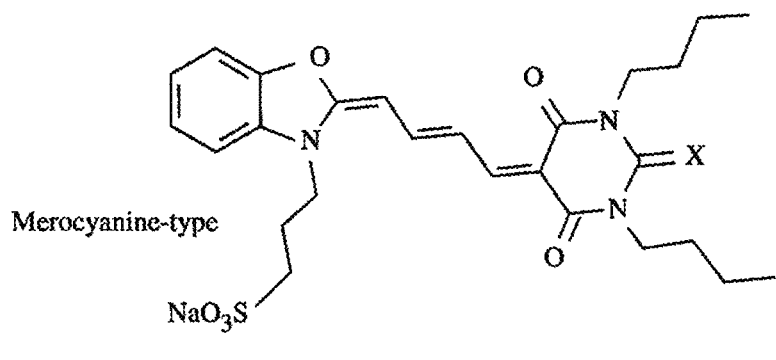
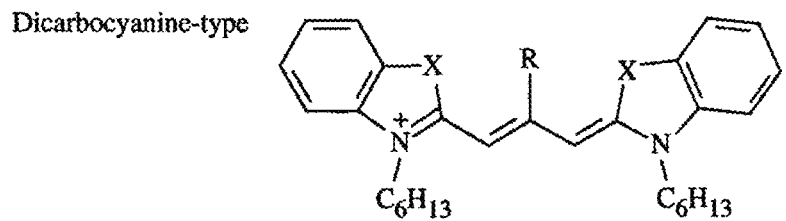
| X | R | X | R |
|---|---|---|---|
| Merocyanines | – | Dicarbocyanines | – |
| O (MC540) | | S | Et |
| S | – | Se | H |
| Se | – | O (DHOCI) | H |
*Fig. 6*

| W | X | Y | Z | |
|---|---|---|---|---|
| O | CH | O | O | psoralen |
| S | CH | O | O | thienocoumarin |
| O | N | O | O | 8-azacoumarin |
| O | CH | O | S | 2-thiofuranocoumarin |
| O | CH | O | Se | 2-selenofuranocoumarin |

| R | $R^1$ | $R^2$ | $R^3$ | |
|---|---|---|---|---|
| R/$R^1$ | -CH$_2$C(OH)MeCH(COMe)- | OMe | OMe | hypocrellin A |
| R/$R^1$ | -CH$_2$CMe=C(COMe)- | OMe | OMe | hypocrellin B |
| -CH$_2$CHMeCOPh | -CH$_2$CHMeOCO-$p$-C$_6$H$_4$OH | OMe | OMe | calphostin C |

TFFRFLNRGGG-K〜〜〜-FIRKFLKKWLL
|
KKHRKHRKHRKHGGG

MH(KH)-20
(mw 4884.91)

DAANEAGGG-K〜〜〜-FIRKFLKKWLL
|
KKHRKHRKHRKHGGG

BL(KH)-20
(mw 4373.4)

TFFRFLNRGGG-K〜〜〜-FIRKFLKKWLL
|
DAANEAGGG

Rose Bengal

TARGETED ANTIMICROBIAL MOIETIES

CROSS-REFERENCE TO RELATED APPLICATIONS

This application claims benefit of and priority to U.S. Ser. No. 61/142,830, filed Jan. 6, 2009, U.S. Ser. No. 61/151,445, filed Feb. 10, 2009, U.S. Ser. No. 61/243,905, filed Sep. 18, 2009, and U.S. Ser. No. 61/243,930, filed Sep. 18, 2009, all of which are incorporated herein by reference in their entirety for all purposes.

STATEMENT OF GOVERNMENTAL SUPPORT

[Not Applicable]

FIELD OF THE INVENTION

The present invention relates to novel targeting peptides, novel antimicrobial peptides, chimeric moieties comprising novel targeting and/or novel antimicrobial peptides and uses thereof.

BACKGROUND OF THE INVENTION

Antibiotic research at the industrial level was originally focused on the identification of refined variants of already existing drugs. This resulted example, in the development of antibiotics such as newer penicillins, cephalosporins, macrolides, and fluoroquinolones.

However, resistance to old and newer antibiotics among bacterial pathogens is evolving rapidly, as exemplified by extended beta-lactamase (ESBL) and quinolone resistant gram-negatives, multi-resistant gonococci, methicillin resistant *Staphylococcus aureus* (MRSA), vancomycin resistant enterococci (VRE), penicillin non-susceptible pneumococci (PNSP) and macrolide resistant pneumococci and streptococci (see, e.g., Panlilo et al. (1992) *Infect Control Hosp Epidemio.*, 13: 582-586; Morris et al. (1995) *Ann Intern Me., d* 123: 250-259, and the like). An overuse, or improper use, of antibiotics is believed to be of great importance for triggering and spread of drug resistant bacteria. Microbes have, in many cases, adapted and are resistant to antibiotics due to constant exposure and improper use of the drugs.

Drug resistant pathogens represent a major economic burden for health-care systems. For example, postoperative and other nosocomial infections will prolong the need for hospital care and increase antibiotic drug expenses. It is estimated that the annual cost of treating drug resistant infections in the United States is approximately $5 billion.

SUMMARY OF THE INVENTION

In certain embodiments, novel targeting moieties (e.g., peptides) that specifically/preferentially bind to microorganisms (e.g., certain bacteria, yeasts, fungi, molds, viruses, algae, protozoa, and the like) are provided. The targeting moieties can be attached to effectors (e.g., detectable labels, drugs, antimicrobial peptides, etc.) to form chimeric constructs for specifically/preferentially delivering the effector to and/or into the target organism. In certain embodiments novel antimicrobial peptides that can be used to inhibit (e.g., kill and/or inhibit growth and/or proliferation) of certain microorganisms (e.g., certain bacteria, yeasts, fungi, molds, viruses, algae, protozoa, and the like) are provided.

Accordingly, in certain embodiments, a chimeric construct (chimeric moiety) is provided comprising: an effector attached to a peptide targeting moiety comprising an amino acid sequence found in Table 3 and/or Table 12; and/or an antimicrobial peptide comprising an amino acid sequence found in Table 4 and/or Table 5 attached to a targeting moiety. In certain embodiments the targeting moiety is a peptide comprising an amino acid sequence of a peptide found one or more of Table 3 and Table 12. In certain embodiments the targeting moiety is a peptide comprising two or more amino acid sequences of a peptide found one or more of Table 3 and Table 12. In certain embodiments the targeting moiety is a peptide whose amino acid sequence consists of the amino acid sequence of a peptide found in Table 3.

In various embodiments the effector comprises a moiety selected from the group consisting of an antimicrobial peptide, an antibiotic, a ligand, a lipid or liposome, a agent that physically disrupts the extracellular matrix within a community of microorganisms, and a polymeric particle. In certain embodiments the effector comprises an antimicrobial peptide comprising an amino acid sequence found in one or more of Tables 4, 5, 14, and Table 15. In certain embodiments the effector comprises an antimicrobial peptide comprising an amino acid sequence found in one or more of Tables 4, and 5. In certain embodiments the effector comprises an antimicrobial peptide comprising an amino acid sequence characterized by a motif selected from the group consisting of KIF, FIK, KIH, HIK, and KIV (e.g., as identified in Table 7). In certain embodiments the construct comprises a targeting peptide comprising an amino acid sequence found in Table 3 attached to an antimicrobial peptide comprising an amino acid sequence found in Table 4 and/or Table 5. In certain embodiments the construct comprises an antimicrobial peptide comprising an amino acid sequence found in Table 4 attached to a targeting moiety comprising an amino acid sequence found in Table 3 and/or Table 10, and/or Table 12. In certain embodiments the construct comprises a targeting peptide comprising an amino acid sequence found in Table 3 attached to an antimicrobial peptide comprising an amino acid sequence found in Table 4.

In various embodiments the targeting moiety is chemically conjugated to the effector (directly or via a linker). In certain embodiments the liker comprises a polyethylene glycol (PEG). In certain embodiments the targeting moiety is chemically conjugated to the effector via a non-peptide linker found in Table 16. In certain embodiments the targeting moiety is linked to the effector via a peptide linkage. In certain embodiments the effector comprises an antimicrobial peptide and the construct is a fusion protein. In certain embodiments the targeting moiety is attached to the effector by a peptide linker comprising or consisting of an amino acid sequence found in Table 16. In certain embodiments any of the constructs and/or peptides described herein bears one or more protecting groups. In certain embodiments the one or more protecting groups are independently selected from the group consisting of acetyl, amide, 3 to 20 carbon alkyl groups, fmoc, tBoc, 9-fluoreneacetyl group, 1-fluorenecarboxylic group, 9-florenecarboxylic group, 9-fluorenone-1-carboxylic group, benzyloxycarbonyl, xanthyl (Xan), trityl (Trt), 4-methyltrityl (Mtt), 4-methoxytrityl (Mmt), 4-methoxy-2,3,6-trimethylbenzenesulphonyl (Mtr), mesitylene-2-sulphonyl (Mts), 4,4-dimethoxybenzhydryl (Mbh), tosyl (Tos), 2,2,5,7,8-pentamethyl chroman-6-sulphonyl (Pmc), 4-methylbenzyl (MeBzl), 4-methoxybenzyl (MeOBzl), benzyloxy (BzlO), benzyl (Bzl), benzoyl (Bz), 3-nitro-2-pyridinesulphenyl (Npys), 1-(4,4-dimentyl-2,6-diaxocyclohexylidene)ethyl (Dde), 2,6-dichlorobenzyl (2,6-DiCl-Bzl), 2-chlorobenzyloxycarbonyl (2-Cl—Z), 2-bromobenzyloxycarbonyl (2-Br—Z), benzyloxymethyl (Bom), t-butoxycarbonyl (Boc), cyclohexyloxy (cHxO), t-butoxymethyl (Bum), t-butoxy (tBuO), t-Butyl (tBu), and trifluoroacetyl (TFA). In certain embodiments the peptide and/or construct comprises a protecting group at a carboxyl and/or amino terminus. In certain embodiments the carboxyl terminus is amidated and/or the amino terminus is acetylated. In various embodiments the chimeric construct and/or peptide is functionalized with a polymer (e.g., comprises polyethylene glycol, cellulose, modified cellulose, dextrin, etc.) to increase serum halflife.

In certain embodiments pharmaceutical compositions are provided. In various embodiments the pharmaceutical compositions comprise a chimeric construct as described herein (e.g., a chimeric construct according to any of claims 1-26) and/or an antimicrobial peptide as described herein, in a pharmaceutically acceptable carrier. In certain embodiments the composition is formulated as a unit dosage formulation. In certain embodiments the composition is formulated for administration by a modality selected from the group consisting of intraperitoneal administration, topical administration, oral administration, inhalation administration, transdermal administration, subdermal depot administration, systemic IV application, ocular administration, and rectal administration.

In certain embodiments isolated antimicrobial peptides are provided. In various embodiments the peptides comprise one or more sequences selected from the amino acid sequences listed in Table 4 and/or Table 5 (and/or the retro, inverso, retroinverso, or beta forms). In various embodiments the antimicrobial peptide bears one or more protecting groups e.g., as described herein.

In certain embodiments a composition effective to kill or to inhibit the growth and/or of a microorganism and/or the formation and/or maintenance of a biofilm is provided. The composition typically comprises one or more isolated antimicrobial peptides, the amino acid sequences of the peptides comprising one or more sequences selected from the amino acid sequences listed in Table 4 and/or Table 5 (and/or their retro, inverso, or retroinverso forms). In certain embodiments the composition is effective to kill or inhibit the growth and/or proliferation of a yeast or fungus, and the composition comprises one or more peptides, the amino acid sequences of the peptides comprising one or more sequences selected from the group of amino acid sequences listed in Table 4 and/or Table 5 identified (e.g., in those tables) as effective to effective to kill or inhibit the growth and/or proliferation of a yeast or fungus. In certain embodiments the composition is effective to kill or inhibit the growth and/or proliferation of *Aspergillus niger* and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *Aspergillus niger*. In certain embodiments the composition is effective to kill or inhibit the growth and/or proliferation of *C. albicans* and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *C. albicans*. In certain embodiments the composition is effective to kill or inhibit the growth and/or proliferation of *T. rubrum* and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *T. rubrum*. In certain embodiments the composition is effective to kill or inhibit the growth and/or proliferation of a bacterium, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of a bacterium. In certain embodiments the composition is effective to kill or inhibit the growth and/or proliferation of a gram positive bacterium, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of a gram positive bacterium. In certain embodiments the composition is effective to kill or inhibit the growth and/or proliferation of *A. naeslundii*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *A. naeslundii*. In certain embodiments the composition is effective to kill or inhibit the growth and/or proliferation of *B. subtilis*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *B. subtilis*. In certain embodiments the composition is effective to kill or inhibit the growth and/or proliferation of *C. difficile*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *C. difficile*. In certain embodiments the composition is effective to kill or inhibit the growth and/or proliferation of *C. jeikeium*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *C. jeikeium*. In certain embodiments the composition is effective to kill or inhibit the growth and/or proliferation of *E. faecalis*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *E. faecalis*. In certain embodiments the composition is effective to kill or inhibit the growth and/or proliferation of *M. luteus*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *M. luteus*. In certain embodiments the composition is effective to kill or inhibit the growth and/or proliferation of MRSA, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of MRSA. In certain embodiments composition is effective to kill or inhibit the growth and/or proliferation of *S. epidermidis*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *S. epidermidis*. In certain embodiments the composition is effective to kill or inhibit the growth and/or proliferation of *S. mutans*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *S. mutans*. In certain embodiments the composition is effective to kill or inhibit the growth and/or proliferation of *S. pneumoniae*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *S. pneumoniae*. In certain embodiments the composition is effective to kill or inhibit the growth and/or proliferation of a gram negative bacterium, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of a gram negative bacterium. In certain embodiments the composition is effective to kill or inhibit the growth and/or proliferation of *A. baumannii*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *A. baumannii*. In certain embodiments the composition is effective to kill or inhibit the growth and/or proliferation of *C. jejuni*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *C. jejuni*. In certain embodiments the composition is effective to kill or inhibit the growth and/or proliferation of *E. coli*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *E. coli*. In certain embodiments the composition is effective to kill or inhibit the growth and/or proliferation of *F. nucleatum*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *F. nucleatum*. In certain embodiments the composition is effective to kill or inhibit the growth and/or proliferation of *E. coli*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *M. xanthus*. In certain embodiments the composition is effective to kill or inhibit the growth and/or proliferation of *P. aeruginosa*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *P. aeruginosa*. In certain embodiments the composition is effective to kill or inhibit the growth and/or proliferation of *P. gingivalis*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *P. gingivalis*. In certain embodiments the composition is effective to kill or inhibit the growth and/or proliferation of *P. mirabilis*, and the composition comprises one or more peptides, the amino acid sequences of the peptides comprising one or more sequences selected from the group of amino acid sequences listed in Table 4 and/or Table 5 identified as effective to effective to kill or inhibit the growth and/or proliferation of *P. mirabilis*.

In various embodiments one or more of the peptides comprising the composition comprise all "L" amino acids or all "D" amino acids, or a mixture of "L" and "D" amino acids. In various embodiments one or more of the peptides comprising the composition are β peptides. In various embodiments one or more of the peptides comprising the composition comprise one or more protecting groups (e.g. protected carboxyl and/or amino termini). In various embodiments one or more of the peptides comprising the composition comprise an amide on the carboxyl terminus and/or an acetyl on the amino terminus. In various embodiments the peptides comprising the composition are in a pharmaceutically acceptable carrier. In certain embodiments the carrier is suitable for administration via a route selected from the group consisting of topical administration, aerosol administration, administration via inhalation, oral administration, and/or rectal administration.

In various embodiments methods are provided for killing and/or inhibiting the growth and/or proliferation of a microorganism and or for disrupting and/or inhibiting the growth and/or maintenance of a biofilm, the method comprising contacting the microorganism (or a biofilm comprising the microorganism) with a chimeric construct as described herein, or with an antimicrobial peptide as described herein, and/or with a composition as described herein. In certain embodiments the microorganism is a yeast or fungus and the chimeric construct or composition is a chimeric construct comprising an effector identified as killing a yeast or fungus, or a composition comprising an antimicrobial peptide described herein as killing a yeast or fungus. In certain embodiments the microorganism is a bacterium (e.g., gram negative and/or gram positive bacterium) and the chimeric construct or composition is a chimeric construct comprising an effector identified as killing a bacterium (e.g., gram negative and/or gram positive bacterium), or a composition comprising an antimicrobial peptide described herein as killing a gram negative and/or gram positive bacterium. In certain embodiments the effector is an antimicrobial peptide. In certain embodiments the microorganism is *S. mutans*, and the chimeric construct or composition is applied to the oral cavity of an animal or human, e.g., to reduces the incidence or severity of dental caries and/or periodontal disease). In certain embodiments the chimeric construct or composition preferentially targets *Corynebacterium* spp. and the chimeric construct or composition is applied to the skin surface of an animal or human (e.g., to reduce body odor).

Methods are also provided for disinfecting a surface. The methods typically involve contacting the surface with one or more chimeric constructs described herein, or a composition as described herein. In certain embodiments, the surface comprises a surface of a prosthesis or medical implant. In certain embodiments the surface comprises a surface of a medical device. In certain embodiments the surface comprises a surface of a plant or foodstuff. In certain embodiments the chimeric construct and/or the antimicrobial peptide(s) are combined with a second disinfectant selected from the group consisting of other antimicrobial agent is a disinfectant selected from the group consisting of acetic acid, phosphoric acid, citric acid, lactic, formic, propionic acid, hydrochloric acid, sulfuric acid, nitric acid, sodium hydroxide, potassium hydroxide, sodium carbonate, ammonium hydroxide, ethyl alcohol, isopropyl alcohol, phenol, formaldehyde, glutaraldehyde, hypochlorites, chlorine dioxide, sodium dichloroisocyanurate, chloramine-T, iodine, povidone-iodine, chlorhexidine, hydrogen peroxide, peracetic acid, and benzalkonium chloride.

In various embodiments the use of a chimeric construct described herein and/or an antimicrobial composition as described herein (e.g., a chimeric construct, or an antimicrobial composition in the manufacture of a medicament for killing and/or inhibiting the growth and/or proliferation of a microorganism and/or inhibiting the growth and/or maintenance of a biofilm comprising the microorganism is provided. In certain embodiments the microorganism is a yeast or fungus and the chimeric construct or composition is a chimeric construct comprising an effector identified as killing a yeast or fungus, or a composition comprising an antimicrobial peptide described herein as killing a yeast or fungus. In certain embodiments the microorganism is a bacterium (e.g., gram negative and/or gram positive bacterium) and the chimeric construct or composition is a chimeric construct comprising an effector identified as killing a bacterium (e.g., gram negative and/or gram positive bacterium), or a composition comprising an antimicrobial peptide described herein as killing a gram negative and/or gram positive bacterium. In certain embodiments the effector is an antimicrobial peptide.

In various embodiments methods are also provided for of detecting a bacterium and/or a bacterial film (e.g., a biofilm comprising the bacteria). The methods typically involve contacting the bacterium or bacterial film with a composition comprising a detectable label attached to a targeting peptide comprising one or more amino acid sequences found Table 3 and/or Table 12; and detecting the detectable label where the quantity and/or location of the detectable label is an indicator of the presence of the bacterium and/or bacterial film. In certain embodiments the targeting peptide comprises or consists of an amino acid sequence of a peptide found in Table 3 (and/or the retro, inverso, retroinverso form of the sequence). In certain embodiments the detectable label is a label selected from the group consisting of a radioactive label, a radioopaque label, a fluorescent dye, a fluorescent protein, an enzymatic label, a colorimetric label, and a quantum dot.

Certain compositions are also provided comprising a photosensitizing or photoactivatable agent attached to a targeting peptide (e.g., a peptide comprising an amino acid sequence of a peptide found in Table 3 and/or Table 12). In certain embodiments the targeting peptide comprises or consists of an amino acid sequence of a peptide found in Table 3. In certain embodiments the photosensitizing agent is an agent selected from the group consisting of a porphyrinic macrocycle, a porphyrin, a chlorine, a crown ether, an acridine, an azine, a phthalocyanine, a cyanine, a psoralen, a cucumin, and a perylenequinonoid. In certain embodiments the photosensitizing agent comprises one or more agents agent shown in any of FIGS. 1-12. In certain embodiments the photosensitizing agent is attached to the targeting peptide by a non-peptide linker (e.g., a polyethylene glycol (PEG)). In certain embodiments the photosensitizing agent is attached to the targeting peptide by a non-peptide linker found in Table 16.

In various embodiments methods are provided for killing and/or for inhibiting the growth and/or proliferation of a microorganism or a biofilm comprising a microorganism, where the methods involve contacting the microorganism or biofilm with a composition comprising a photosensitizing or photoactivatable agent attached to a targeting peptide (e.g., a peptide comprising an amino acid sequence of a peptide found in Table 3 and/or Table 12). In certain embodiments the targeting peptide comprises or consists of an amino acid sequence of a peptide found in Table 3. In certain embodiments the photosensitizing agent is an agent selected from the group consisting of a porphyrinic macrocycle, a porphyrin, a chlorine, a crown ether, an acridine, an azine, a phthalocyanine, a cyanine, a psoralen, a cucumin, and a perylenequinonoid. In certain embodiments the photosensitizing agent comprises one or more agents agent shown in any of FIGS. 1-12. In certain embodiments the photosensitizing agent is attached to the targeting peptide by a non-peptide linker (e.g., a polyethylene glycol (PEG)). In certain embodiments the photosensitizing agent is attached to the targeting peptide by a non-peptide linker found in Table 16. In certain embodiments the method further comprises exposing the microorganism or biofilm to a light source. In certain embodiments the microorganism is a microorganism selected from the group consisting of a bacterium (e.g., a gram positive and/or a gram negative bacterium), a yeast, a fungus, a protozoan, and a virus. In certain embodiments the biofilm comprises a bacterial film. In certain embodiments the biofilm is a biofilm on an implanted or implantable medical device. In certain embodiments the microorganism or biofilm is an organism or biofilm in an oral cavity.

In various embodiments certain formulations are provided. Typical formulations include, but are not limited to a targeting peptide, an antimicrobial peptide, and/or a STAMP; and a salt at a concentration comparable to that found in phosphate buffered saline (PBS) ranging from about 0.5×PBS to about 2.5×PBS. In certain embodiments the formulation comprises a targeting peptide found in Tables 3 or 10. In certain embodiments the formulation comprises an anti-*S. mutans* peptide targeting peptide (e.g., as identified in Tables 3 or 12). In certain embodiments the anti-*S. mutans* targeting peptide has the amino acid sequence TFFRLFNRSFTQALGK (SEQ ID NO:1). In certain embodiments the anti-*S. mutans* targeting peptide is attached to an antimicrobial peptide. In certain embodiments the antimicrobial peptide is a peptide found in Tables 4, 5, or 14. In certain embodiments the antimicrobial peptide has the amino acid sequence KNLRIIRKGIHIIKKY (SEQ ID NO:3080). In certain embodiments the formulation comprises the amino acid sequence of the C16G2 STAMP (TFFRLFNRSFTQALGKGGGKNLRIIRKGIHIIKKY, (SEQ ID NO:2). In various embodiments the targeting peptide, antimicrobial peptide, and/or a STAMP bears one or more protecting groups. In certain embodiments the protecting group(s) are independently selected from the group consisting of acetyl, amide, 3 to 20 carbon alkyl groups, Fmoc, Tboc, 9-fluoreneacetyl group, 1-fluorenecarboxylic group, 9-florenecarboxylic group, 9-fluorenone-1-carboxylic group, benzyloxycarbonyl, Xanthyl (Xan), Trityl (Trt), 4-methyltrityl (Mtt), 4-methoxytrityl (Mmt), 4-methoxy-2,3,6-trimethyl-benzenesulphonyl (Mtr), Mesitylene-2-sulphonyl (Mts), 4,4-dimethoxybenzhydryl (Mbh), Tosyl (Tos), 2,2,5,7,8-pentamethyl chroman-6-sulphonyl (Pmc), 4-methylbenzyl (MeBzl), 4-methoxybenzyl (MeOBzl), Benzyloxy (BzlO), Benzyl (Bzl), Benzoyl (Bz), 3-nitro-2-pyridinesulphenyl (Npys), 1-(4,4-dimentyl-2,6-diaxocyclohexylidene)ethyl (Dde), 2,6-dichlorobenzyl (2,6-DiCl-Bzl), 2-chlorobenzyloxycarbonyl (2-Cl—Z), 2-bromobenzyloxycarbonyl (2-Br—Z), Benzyloxymethyl (Bon), t-butoxycarbonyl (Boc), cyclohexyloxy (cHxO), t-butoxymethyl (Bum), t-butoxy (tBuO), t-Butyl (tBu), and Trifluoroacetyl (TFA). In certain embodiments the targeting peptide, antimicrobial peptide, and/or a STAMP is amidated at the carboxyl terminus and/or bears an acetyl group at the amino terminus. In certain embodiments the pH of the formulation ranges from about pH 5.0 to about pH 8.5. In certain embodiments the pH is about pH 7.4. In various embodiments the salt is at a concentration comparable to that found in 1×PBS. In certain embodiments the formulation comprises PBS. In certain embodiments the formulation of further comprising ethanol, and/or glycerin, and/or polyethylene glycol, and/or fluoride.

Definitions

The term "peptide" as used herein refers to a polymer of amino acid residues typically ranging in length from 2 to about 50 or about 60 residues. In certain embodiments the peptide ranges in length from about 2, 3, 4, 5, 7, 9, 10, or 11 residues to about 60, 50, 45, 40, 45, 30, 25, 20, or 15 residues. In certain embodiments the peptide ranges in length from about 8, 9, 10, 11, or 12 residues to about 15, 20 or 25 residues. In certain embodiments the amino acid residues comprising the peptide are "L-form" amino acid residues, however, it is recognized that in various embodiments, "D" amino acids can be incorporated into the peptide. Peptides also include amino acid polymers in which one or more amino acid residues is an artificial chemical analogue of a corresponding naturally occurring amino acid, as well as to naturally occurring amino acid polymers. In addition, the term applies to amino acids joined by a peptide linkage or by other, "modified linkages" (e.g., where the peptide bond is replaced by an α-ester, a β-ester, a thioamide, phosphonamide, carbonate, hydroxylate, and the like (see, e.g., Spatola, (1983) *Chem. Biochem. Amino Acids and Proteins* 7: 267-357), where the amide is replaced with a saturated amine (see, e.g., Skiles et al., U.S. Pat. No. 4,496,542, which is incorporated herein by reference, and Kaltenbronn et al., (1990) Pp. 969-970 in Proc. 11th American Peptide Symposium, ESCOM Science Publishers, The Netherlands, and the like)).

The term "residue" as used herein refers to natural, synthetic, or modified amino acids. Various amino acid analogues include, but are not limited to 2-aminoadipic acid, 3-aminoadipic acid, beta-alanine (beta-aminopropionic acid), 2-aminobutyric acid, 4-aminobutyric acid, piperidinic acid, δ-aminocaproic acid, 2-aminoheptanoic acid, 2-aminoisobutyric acid, 3-aminoisobutyric acid, 2-aminopimelic acid, 2,4 diaminobutyric acid, desmosine, 2,2'-diaminopimelic acid, 2,3-diaminopropionic acid, n-ethylglycine, n-ethylasparagine, hydroxylysine, allo-hydroxylysine, 3-hydroxyproline, 4-hydroxyproline, isodesmosine, allo-isoleucine, n-methylglycine, sarcosine, n-methylisoleucine, 6-n-methyllysine, n-methylvaline, norvaline, norleucine, ornithine, and the like. These modified amino acids are illustrative and not intended to be limiting.

"β-peptides" comprise of "β amino acids", which have their amino group bonded to the β carbon rather than the α-carbon as in the 20 standard biological amino acids. The only commonly naturally occurring β amino acid is β-alanine.

Peptoids, or N-substituted glycines, are a specific subclass of peptidomimetics. They are closely related to their natural peptide counterparts, but differ chemically in that their side chains are appended to nitrogen atoms along the molecule's backbone, rather than to the α-carbons (as they are in natural amino acids).

The terms "conventional" and "natural" as applied to peptides herein refer to peptides, constructed only from the naturally-occurring amino acids: Ala, Cys, Asp, Glu, Glu, Phe, Gly, His, Ile, Lys, Leu, Met, Asn, Pro, Gln, Arg, Ser, Thr, Val, Trp, and Tyr. A compound of the invention "corresponds" to a natural peptide if it elicits a biological activity (e.g., antimicrobial activity) related to the biological activity and/or specificity of the naturally occurring peptide. The elicited activity may be the same as, greater than or less than that of the natural peptide. In general, such a peptoid will have an essentially corresponding monomer sequence, where a natural amino acid is replaced by an N-substituted glycine derivative, if the N-substituted glycine derivative resembles the original amino acid in hydrophilicity, hydrophobicity, polarity, etc. The following are illustrative, but non-limiting N-substituted glycine replacements: N-(1-methylprop-1-yl)glycine substituted for isoleucine (Ile), N-(prop-2-yl)glycine for valine (Val), N-benzylglycine for phenylanlaine (Phe), N-(2-hydroxyethyl)glycine for serine (Ser), and the like. In certain embodiments substitutions need not be "exact". Thus for example, in certain embodiments N-(2-hydroxyethyl)glycine may substitute for Ser, Thr, Cys, and/or Met; N-(2-methylprop-1-yl)glycine may substitute for Val, Leu, and/or Ile. In certain embodiments N-(2-hydroxyethyl)glycine can be used to substitute for Thr and Ser, despite the structural differences: the side chain in N-(2-hydroxyethyl)glycine is one methylene group longer than that of Ser, and differs from Thr in the site of hydroxy-substitution. In general, one may use an N-hydroxyalkyl-substituted glycine to substitute for any polar amino acid, an N-benzyl- or N-aralkyl-substituted glycine to replace any aromatic amino acid (e.g., Phe, Trp, etc.), an N-alkyl-substituted glycine such as N-butylglycine to replace any nonpolar amino acid (e.g., Leu, Val, Ile, etc.), and an N-(aminoalkyl)glycine derivative to replace any basic polar amino acid (e.g., Lys and Arg).

Where an amino acid sequence is provided herein, L-, D-, or beta amino acid versions of the sequence are also contemplated as well as retro, inversion, and retro-inversion isoforms. In addition, conservative substitutions (e.g., in the binding peptide, and/or antimicrobial peptide, and/or linker peptide) are contemplated. Non-protein backbones, such as PEG, alkane, ethylene bridged, ester backbones, and other backbones are also contemplated. Also fragments ranging in length from about 5, 6, 7, 8, 9, 10, 11, 12, 13, 14, 15, 16, 17, 18, 19, 20, 21, 22, 23, 24, or 25 amino acids up to the full length minus one amino acid of the peptide are contemplated where the fragment retains at least 50%, preferably at least 60% 70% or 80%, more preferably at least 90%, 95%, 98%, 99%, or at least 100% of the activity (e.g., binding specificity and/or avidity, antimicrobial activity, etc.) of the full length peptide are contemplated.

A "compound antimicrobial peptide" or "compound AMP" refers to a construct comprising two or more AMPs joined together. The AMPs can be joined directly or through a linker. They can be chemically conjugated or, where joined directly together or through a peptide linker can comprise a fusion protein.

In certain embodiments, conservative substitutions of the amino acids comprising any of the sequences described herein are contemplated. In various embodiments one, two, three, four, or five different residues are substituted. The term "conservative substitution" is used to reflect amino acid substitutions that do not substantially alter the activity (e.g., antimicrobial activity and/or specificity) of the molecule. Typically conservative amino acid substitutions involve substitution one amino acid for another amino acid with similar chemical properties (e.g. charge or hydrophobicity). Certain conservative substitutions include "analog substitutions" where a standard amino acid is replaced by a non-standard (e.g., rare, synthetic, etc) amino acid differing minimally from the parental residue. Amino acid analogs are considered to be derived synthetically from the standard amino acids without sufficient change to the structure of the parent, are isomers, or are metabolite precursors. Examples of such "analog substitutions" include, but are not limited to, 1) Lys-Orn, 2) Leu-Norleucine, 3) Lys-Lys[TFA], 4) Phe-Phe[Gly], and 5) δ-amino butylglycine-ξ-amino hexylglycine, where Phe[gly] refers to phenylglycine (a Phe derivative with a H rather than $CH_3$ component in the R group), and Lys[TFA] refers to a Lys where a negatively charged ion (e.g., TFA) is attached to the amine R group. Other conservative substitutions include "functional substitutions" where the general chemistries of the two residues are similar, and can be sufficient to mimic or partially recover the function of the native peptide. Strong functional substitutions include, but are not limited to 1) Gly/Ala, 2) Arg/Lys, 3) Ser/Tyr/Thr, 4) Leu/Ile/Val, 5) Asp/Glu, 6) Gln/Asn, and 7) Phe/Trp/Tyr, while other functional substitutions include, but are not limited to 8) Gly/Ala/Pro, 9) Tyr/His, 10) Arg/Lys/His, 11) Ser/Thr/Cys, 12) Leu/Ile/Val/Met, and 13) Met/Lys (special case under hydrophobic conditions). Various "broad conservative substations" include substitutions where amino acids replace other amino acids from the same biochemical or biophysical grouping. This is similarity at a basic level and stems from efforts to classify the original 20 natural amino acids. Such substitutions include 1) nonpolar side chains: Gly/Ala/Val/Leu/Ile/Met/Pro/Phe/Trp, and/or 2) uncharged polar side chains Ser/Thr/Asn/Gln/Tyr/Cys. In certain embodiments broad-level substitutions can also occur as paired substitutions. For example, Any hydrophilic neutral pair [Ser, Thr, Gln, Asn, Tyr, Cys]+[Ser, Thr, Gln, Asn, Tyr, Cys] can may be replaced by a charge-neutral charged pair [Arg, Lys, His]+ [Asp, Glu]. The following six groups each contain amino acids that, in certain embodiments, are typical conservative substitutions for one another: 1) Alanine (A), Serine (S), Threonine (T); 2) Aspartic acid (D), Glutamic acid (E); 3) Asparagine (N), Glutamine (Q); 4) Arginine (R), Lysine (K), Histidine (H); 5) Isoleucine (I), Leucine (L), Methionine (M), Valine (V); and 6) Phenylalanine (F), Tyrosine (Y), Tryptophan (W). Where amino acid sequences are disclosed herein, amino acid sequences comprising, one or more of the above-identified conservative substitutions are also contemplated.

In certain embodiments, targeting peptides, antimicrobial peptides, and/or STAMPs compromising at least 80%, preferably at least 85% or 90%, and more preferably at least 95% or 98% sequence identity with any of the sequences described herein are also contemplated. The terms "identical" or percent "identity," refer to two or more sequences that are the same or have a specified percentage of amino acid residues that are the same, when compared and aligned for maximum correspondence, as measured using one of the following sequence comparison algorithms or by visual inspection. With respect to the peptides of this invention sequence identity is determined over the full length of the peptide. For sequence comparison, typically one sequence acts as a reference sequence, to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. Optimal alignment of sequences for comparison can be conducted, e.g., by the local homology algorithm of Smith & Waterman (1981) *Adv. Appl. Math.* 2: 482, by the homology alignment algorithm of Needleman & Wunsch (1970) *J. Mol. Biol.* 48: 443, by the search for similarity method of Pearson & Lipman (1988) *Proc. Natl. Acad. Sci., USA,* 85: 2444, by computerized implementations of these algorithms (GAP, BESTFIT, FASTA, and TFASTA in the Wisconsin Genetics Software Package, Genetics Computer Group, 575 Science Dr., Madison, Wis.), or by visual inspection.

The term "specificity" when used with respect to the antimicrobial activity of a peptide indicates that the peptide preferentially inhibits growth and/or proliferation and/or kills a particular microbial species as compared to other related and/or unrelated microbes. In certain embodiments the preferential inhibition or killing is at least 10% greater (e.g., $LD_{50}$ is 10% lower), preferably at least 20%, 30%, 40%, or 50%, more preferably at least 2-fold, at least 5-fold, or at least 10-fold greater for the target species.

"Treating" or "treatment" of a condition as used herein may refer to preventing the condition, slowing the onset or rate of development of the condition, reducing the risk of developing the condition, preventing or delaying the development of symptoms associated with the condition, reducing or ending symptoms associated with the condition, generating a complete or partial regression of the condition, or some combination thereof.

The term "consisting essentially of" when used with respect to an antimicrobial peptide (AMP) or AMP motif as described herein, indicates that the peptide or peptides encompassed by the library or variants, analogues, or derivatives thereof possess substantially the same or greater antimicrobial activity and/or specificity as the referenced peptide. In certain embodiments substantially the same or greater antimicrobial activity indicates at least 80%, preferably at least 90%, and more preferably at least 95% of the anti microbial activity of the referenced peptide(s) against a particular bacterial species (e.g., *S. mutans*).

The term "porphyrinic macrocycle" refers to a porphyrin or porphyrin derivative. Such derivatives include porphyrins with extra rings ortho-fused, or orthoperifused, to the porphyrin nucleus, porphyrins having a replacement of one or more carbon atoms of the porphyrin ring by an atom of another element (skeletal replacement), derivatives having a replacement of a nitrogen atom of the porphyrin ring by an atom of another element (skeletal replacement of nitrogen), derivatives having substituents other than hydrogen located at the peripheral (meso-, .beta.-) or core atoms of the porphyrin, derivatives with saturation of one or more bonds of the porphyrin (hydroporphyrins, e.g., chlorins, bacteriochlorins, isobacteriochlorins, decahydroporphyrins, corphins, pyrrocorphins, etc.), derivatives obtained by coordination of one or more metals to one or more porphyrin atoms (metalloporphyrins), derivatives having one or more atoms, including pyrrolic and pyrromethenyl units, inserted in the porphyrin ring (expanded porphyrins), derivatives having one or more groups removed from the porphyrin ring (contracted porphyrins, e.g., corrin, corrole) and combinations of the foregoing derivatives (e.g. phthalocyanines, porphyrazines, naphthalocyanines, subphthalocyanines, and porphyrin isomers). Certain porphyrinic macrocycles comprise at least one 5-membered ring.

As used herein, an "antibody" refers to a protein consisting of one or more polypeptides substantially encoded by immunoglobulin genes or fragments of immunoglobulin genes. The recognized immunoglobulin genes include the kappa, lambda, alpha, gamma, delta, epsilon and mu constant region genes, as well as myriad immunoglobulin variable region genes. Light chains are classified as either kappa or lambda. Heavy chains are classified as gamma, mu, alpha, delta, or epsilon, which in turn define the immunoglobulin classes, IgG, IgM, IgA, IgD and IgE, respectively.

A typical immunoglobulin (antibody) structural unit is known to comprise a tetramer. Each tetramer is composed of two identical pairs of polypeptide chains, each pair having one "light" (about 25 kD) and one "heavy" chain (about 50-70 kD). The N-terminus of each chain defines a variable region of about 100 to 110 or more amino acids primarily responsible for antigen recognition. The terms variable light chain ($V_L$) and variable heavy chain ($V_H$) refer to these light and heavy chains respectively.

Antibodies exist as intact immunoglobulins or as a number of well characterized fragments produced by digestion with various peptidases. Thus, for example, pepsin digests an antibody below the disulfide linkages in the hinge region to produce F(ab)'$_2$, a dimer of Fab which itself is a light chain joined to $V_H$-$C_H$1 by a disulfide bond. The F(ab)'$_2$ may be reduced under mild conditions to break the disulfide linkage in the hinge region thereby converting the (Fab')$_2$ dimer into an Fab' monomer. The Fab' monomer is essentially an Fab with part of the hinge region (see, *Fundamental Immunology*, W. E. Paul, ed., Raven Press, N.Y. (1993), for a more detailed description of other antibody fragments). While various antibody fragments are defined in terms of the digestion of an intact antibody, one of skill will appreciate that such Fab' fragments may be synthesized de novo either chemically or by utilizing recombinant DNA methodology. Thus, the term antibody, as used herein also includes antibody fragments either produced by the modification of whole antibodies or synthesized de novo using recombinant DNA methodologies, including, but are not limited to, Fab'$_2$, IgG, IgM, IgA, scFv, dAb, nanobodies, unibodies, and diabodies.

In certain embodiments antibodies and fragments of the present invention can be bispecific. Bispecific antibodies or fragments can be of several configurations. For example, bispecific antibodies may resemble single antibodies (or antibody fragments) but have two different antigen binding sites (variable regions). In various embodiments bispecific antibodies can be produced by chemical techniques (Kranz et al. (1981)*Proc. Natl. Acad. Sci., USA*, 78: 5807), by "polydoma" techniques (see, e.g., U.S. Pat. No. 4,474,893), or by recombinant DNA techniques. In certain embodiments bispecific antibodies of the present invention can have binding specificities for at least two different epitopes, at least one of which is an epitope of a microbial organism. The microbial binding antibodies and fragments can also be heteroantibodies. Heteroantibodies are two or more antibodies, or antibody binding fragments (e.g., Fab) linked together, each antibody or fragment having a different specificity.

The term "STAMP" refers to Specifically Targeted Anti-Microbial Peptides. In various embodiments, a STAMP comprises one or more peptide targeting moieties attached to one or more antimicrobial moieties (e.g., antimicrobial peptides (AMPs)). An MH-STAMP is a STAMP bearing two or more targeting domains (i.e., a multi-headed STAMP).

The terms "isolated" "purified" or "biologically pure" refer to material which is substantially or essentially free from components that normally accompany it as found in its native state. In the case of a peptide, an isolated (naturally occurring) peptide is typically substantially free of components with which it is associated in the cell, tissue, or organism. The term isolated also indicates that the peptide is not present in a phage display, yeast display, or other peptide library.

In various embodiments the amino acid abbreviations shown in Table 1 are used herein.

TABLE 1

Amino acid abbreviations.

| Name | Abbreviation 3 Letter | Abbreviation 1 Letter |
|---|---|---|
| Alanine | Ala | A |
| βAlanine (NH$_2$—CH$_2$—CH$_2$—COOH) | βAla | — |
| Arginine | Arg | R |
| Asparagine | Asn | N |
| Aspartic Acid | Asp | D |
| Cysteine | Cys | C |
| Glutamic Acid | Glu | E |
| Glutamine | Gln | Q |
| Glycine | Gly | G |
| Histidine | His | H |
| Homoserine | Hse | — |
| Isoleucine | Ile | I |
| Leucine | Leu | L |
| Lysine | Lys | K |
| Methionine | Met | M |
| Methionine sulfoxide | Met (O) | — |
| Methionine methylsulfonium | Met (S-Me) | — |
| Norleucine | Nle | — |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |
| episilon-aminocaproic acid (NH$^2$—(CH$_2$)$_5$—COOH) | Ahx | J |
| 4-aminobutanoic acid (NH$_2$—(CH$_2$)$_3$—COOH) | gAbu | — |
| tetrahydroisoquinoline-3-carboxylic acid | | O |
| Lys(N(epsilon)-trifluoroacetyl) | | K[TFA] |
| α-aminoisobutyric acid | Aib | B |

BRIEF DESCRIPTION OF THE DRAWINGS

FIG. 2 shows some illustrative porphyrins (compounds 100-118) suitable for use as targeting moieties and/or antimicrobial effectors.

FIG. 5 illustrates certain azine photosensitizers suitable for use as targeting moieties and/or antimicrobial effectors in the compositions and methods described herein.

FIG. 6 shows illustrative cyanine suitable for use as targeting moieties and/or antimicrobial effectors in the compositions and methods described herein.

FIG. 15 illustrates various MH-STAMPs used in Example 1. The design, sequence, and observed mass (m/z) for M8(KH)-20 (SEQ ID NOs:4, 5, and 6), BL(KH)-20 (SEQ ID 7, 8, and 9), and M8(BL)-20 (SEQ ID 10, 11, and 12).

DETAILED DESCRIPTION

Figure 1:
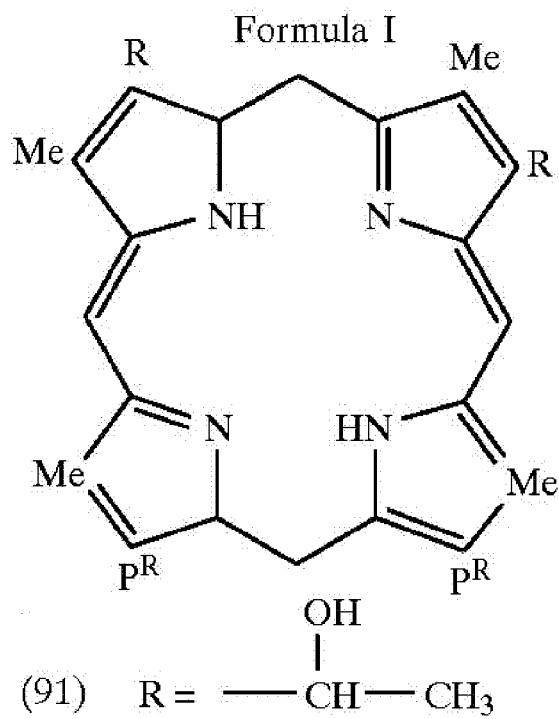
FIG. 1 shows some illustrative porphyrins (compounds 92-99) suitable for use as targeting moieties and/or antimicrobial effectors.
Figure 3:
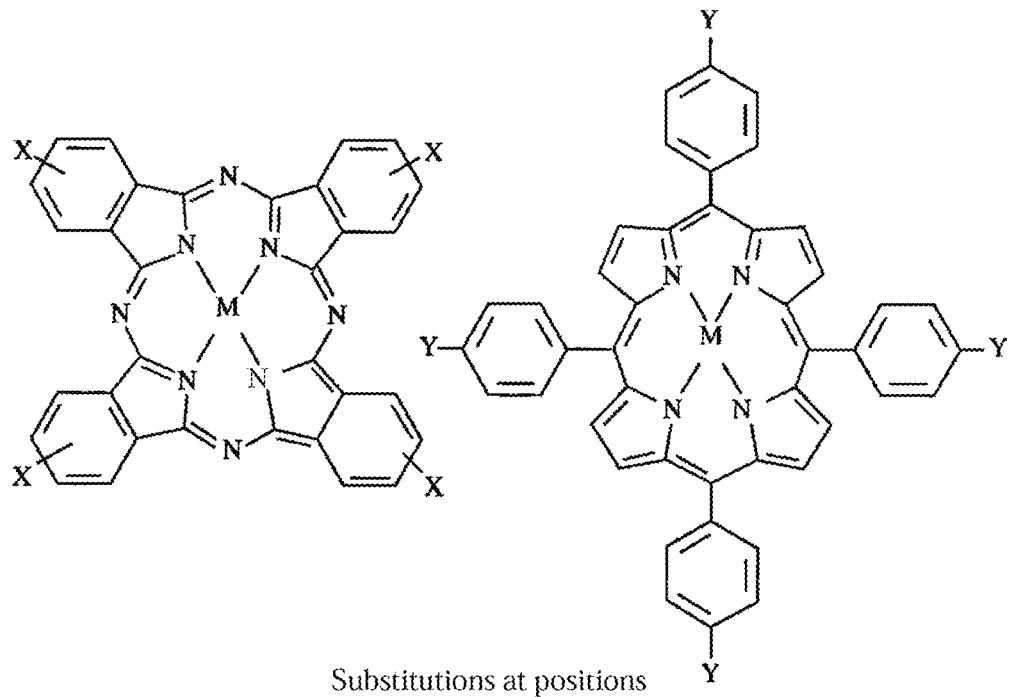
FIG. 3 shows some illustrative porphyrins (in particular phthalocyanines) (compounds 119-128) suitable for use as targeting moieties and/or antimicrobial effectors.
Figure 4:
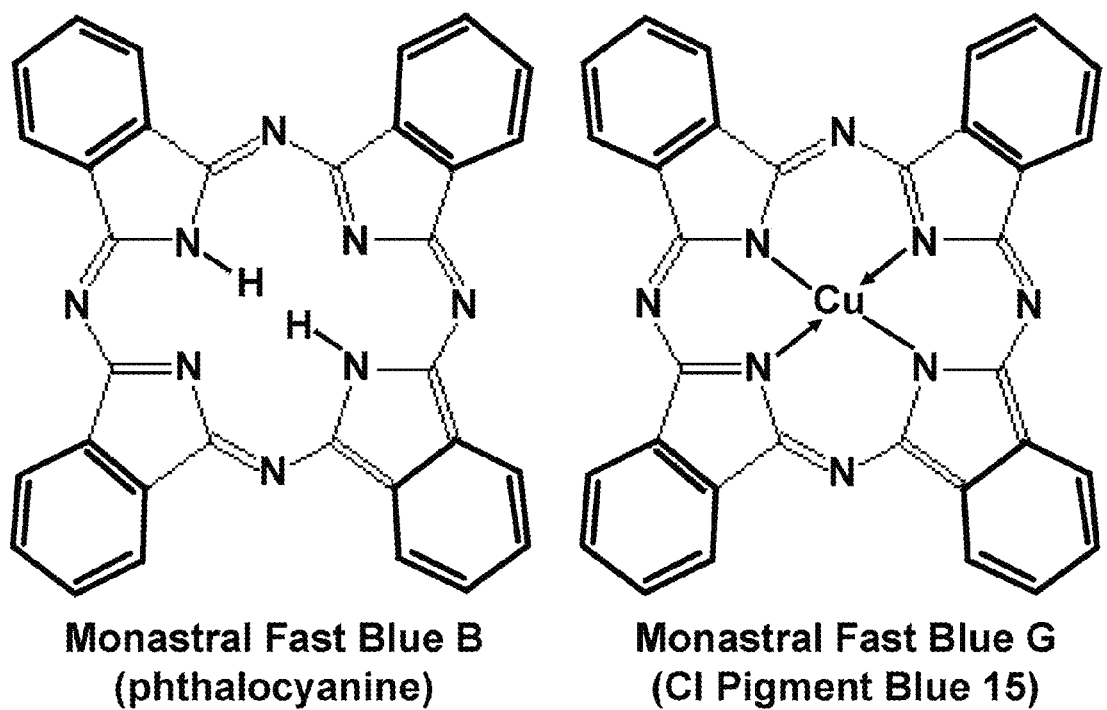
FIG. 4 illustrates the structures of two phthalocyanines, Monoastral Fast Blue B and Monoastral Fast Blue G suitable for use as targeting moieties and/or antimicrobial effectors.
Figure 7:
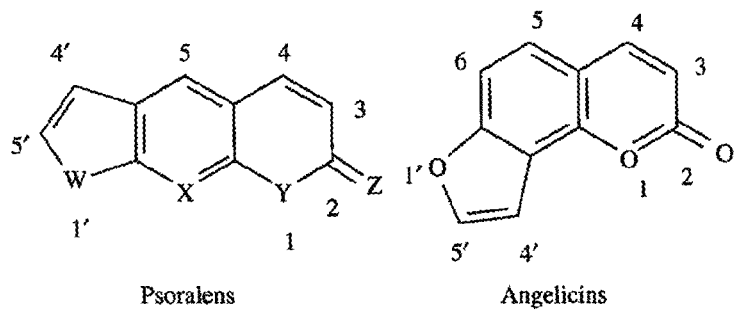
FIG. 7 shows illustrative psoralen (angelicin) photosensitizers suitable for use as targeting moieties and/or antimicrobial effectors in the compositions and methods described herein.
Figure 8:
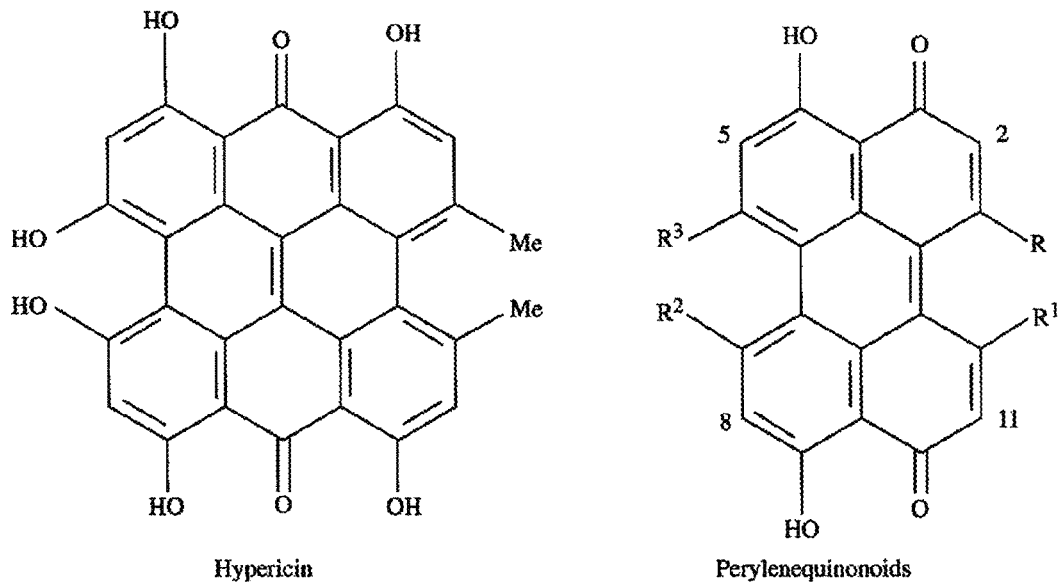
FIG. 8 shows illustrative hypericin and the perylenequinonoid pigments suitable for use as targeting moieties and/or antimicrobial effectors in the compositions and methods described herein.
Figure 9:
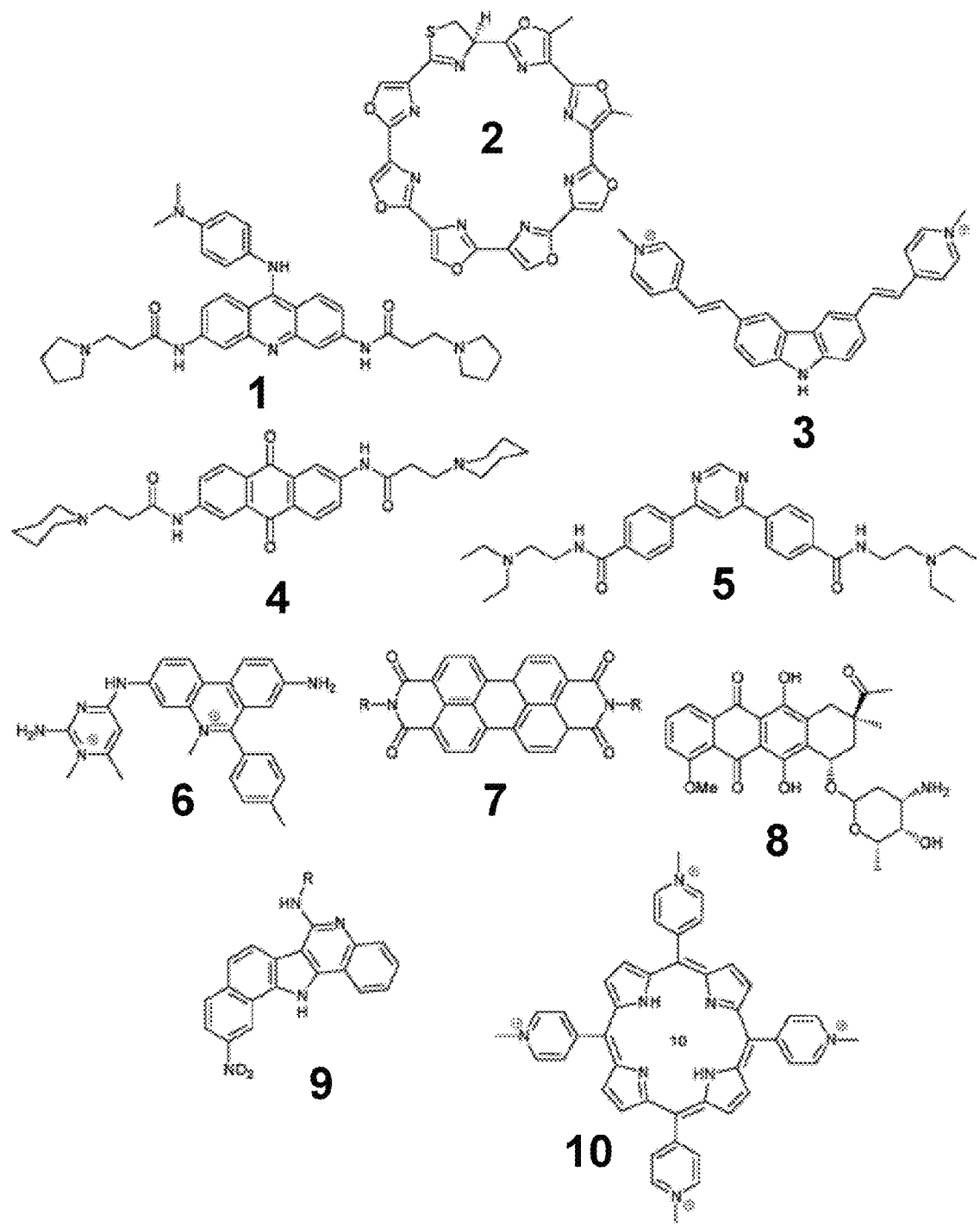
FIG. 9 shows illustrative acridines suitable for use as targeting moieties and/or antimicrobial effectors in the compositions and methods described herein.
Figure 10:
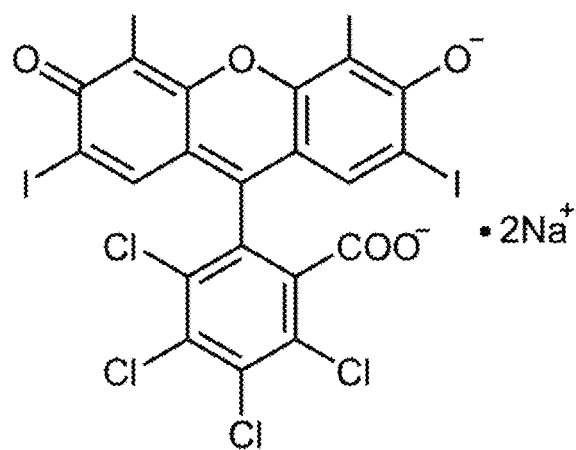
FIG. 10 illustrates the structure of the acridine Rose Bengal.
Figure 11:
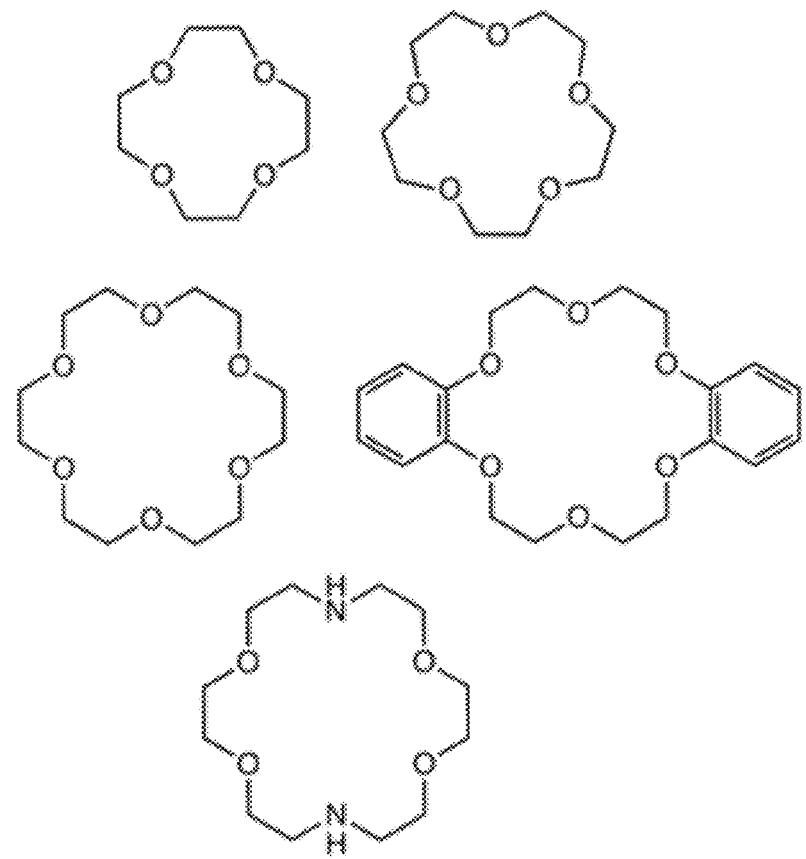
FIG. 11 illustrates various crown ethers suitable for use as targeting moieties and/or antimicrobial effectors in the compositions and methods described herein.

In various embodiments, novel "targeting" peptides are identified that specifically or preferentially bind particular microorganisms (e.g., bacteria, yeasts, fungi, etc.). These peptides can be used alone to bind/capture and thereby identify and/or isolate particular target microorganisms, or they can be attached to one or more effectors (e.g., drugs, labels, etc.) and used as targeting moieties thereby providing a chimeric moiety that preferentially or specifically delivers the effector to a target microorganism, a population of target microorganisms, a microbial film, a biofilm, and the like.

In various embodiments novel peptides having antimicrobial activity against certain bacteria, fungi, yeasts, and/or viruses and/or having activity that inhibits the growth or maintenance of biofilms comprising such microorganisms are provided. The AMPs can be used to inhibit the growth and/or proliferation of a microbial species and/or the growth and/formation and/or maintenance of a biofilm comprising the microbial species.

In certain embodiments, the targeting moieties can be attached to antimicrobial peptides to form Specifically Targeted Anti-Microbial Peptides (STAMPs). In certain embodiments attachment of one or more targeting moieties/peptides to one or more antimicrobial peptides can narrow the spectrum of activity of the AMP(s) to provide efficacy against one or a few target microorganisms without substantially disrupting the remaining microbial ecology and thereby provide increased efficacy with fewer side effects.

In certain embodiments STAMPs or effector peptides can be delivered against pathogenic bacteria by being cloned and expressed in probiotic organisms for therapeutic delivery in vivo. Recombinant expression (and overexpression) and export of antimicrobial peptides and other peptides are well documented in bacteria, including species that are also utilized as probiotics.

In various embodiments the targeting peptides, antimicrobial peptides, and/or STAMPs can be formulated individually, in combination with each other, in combination with other antimicrobial peptides, and/or in combination with various antibacterial agents to provide antimicrobial reagents and/or pharmaceuticals.

Accordingly, in certain embodiments this invention provides peptides having antimicrobial activity, compositions comprising the peptides, methods of using the peptides (or compositions thereof) to inhibit the growth of or kill a wide variety of microbial targets and methods of using the peptides (or compositions thereof) to treat or prevent microbial infections and diseases related thereto in both plants and animals.

The various peptides (targeting peptides, AMPs, STAMPs, etc.) described herein exhibit antimicrobial activity, being biostatic or biocidal against a certain microbial targets, including but not limited to, Gram-negative bacteria such as *Acinetobacter baumannii, Escherichia coli, Fusobacterium nucleatum, Pseudomonas aeruginosa, Porphyromonas gingivalis*; Gram-positive bacteria such as *Actinomyces naeslundii, Bacillus subtilis, Clostridium difficile, Enterococcus faecalis, Staphylococcus aureus* (and MRSA), *S. epidermidis, Streptococcus mutans, Streptococcus pneumoniae*; and yeast or fungi such as *Aspergillus niger, Candida albicans, Malassezia furfur*, and *Trichophyton rubrum* (see, e.g., Table 2). Significantly, various peptides described herein are biostatic or biocidal against clinically relevant pathogens exhibiting multi-drug resistance such as, for example, methicillin-resistant *Staphylococcus aureus* ("MRSA").

TABLE 2

Illustrative target microorganisms and associated pathology.

| | |
|---|---|
| *Acinetobacter baumannii* (*A. baumannii*) | Pathogenic gram-negative *bacillus* that is naturally sensitive to relatively few antibiotics. |
| *Actinomyces naeslundii* (*A. naeslundii*) | Gram positive rod shaped bacteria that occupy the oral cavity and are implicated in periodontal disease and root caries. |
| *Aspergillus niger* (*A. niger*) | A fungal infection that often causes a black mould to appear on some fruit and vegetables but may also infect humans through inhalation of fungal spores. |
| *Bacteroides fragilis* (*B. fragilis*) | Gram positive *bacilli* that are opportunistic human pathogens, causing infections of the peritoneal cavity, gastrointestinal surgery, and appendicitis via abscess formation, inhibiting phagocytosis. Resistant to a wide variety of antibiotics - β-lactams, aminoglycosides, and recently many species have acquired resistance to erythromycin and tetracycline. |
| *Bacillus subtilis* (*B. subtilis*) | Gram-positive, catalase-positive bacterium. |
| *Candida albicans* (*C. albicans*) | Causal agent of opportunistic oral and genital fungal infections in humans. |
| *Clostridium difficile* (*C. difficile*) | A gram-positive, anaerobic, spore-forming *bacillus* that is responsible for the development of antibiotic-associated diarrhea and colitis. |
| *Corynebacterium jeikeium* (*C. jeikeium*) | Gram positive, opportunistic pathogen primarily of immunocompromised (neutropenic) patients. Highly resistant to antibiotics |
| *Campylobacter jejuni* (*C. jejuni*) | Gram negative cause of human gastroenteritis/food poisoning. |
| *Escherichia coli* (*E. coli*) | Gram negative rod-shaped bacterium commonly found in the lower intestine of warm-blooded organisms. Certain strains cause serious food poisoning in humans. |
| *Enterococcus faecalis* (*E. faecalis*) | Gram-positive commensal bacterium |
| *Fusobacterium nucleatum* (*F. nucleatum*) | Gram negative schizomycetes bacterium often seen in necrotic tissue and implicated, but not conclusively, with other organisms in the causation and perpetuation of periodontal disease. |
| *Lactobacillus acidophilus* (*L. acidophilus*) | Gram-positive commensal bacterium. |
| *Legionella pneumophila* (*L. pneumophila*) | Gram negative bacterium that is the causative agent of legionellosis or Legionnaires' disease. |
| (*Micrococcus luteus*) *M. luteus* | Gram positive, spherical, saprotrophic bacterium found in soil, dust, water and air, and as part of the normal flora of the mammalian skin. The bacterium also colonizes the human mouth, mucosae, oropharynx and upper respiratory tract. Considered an emerging nosocomial pathogen in immunocompromised patients. |
| *Mycobacterium smegmatis* (*M. smegmatis*) | Gram-variable (acid-fast) soil-dwelling organism utilized as a proxy for *Mycobacterium tuberculosis* during research and development. |
| *Malassezia furfur* (*M. furfur*) | Yeast - cutaneous pathogen. |
| Methicillin-resistant *Staphylococcus aureus* (MRSA) | Any strain of *Staphylococcus aureus* bacteria (gram positive) that is resistant to a one or more members of a large group of antibiotics called the beta-lactams. Responsible for skin and systemic infections. |
| *Myxococcus xanthus* (*M. xanthus*) | Gram negative cells that form biofilms and display primitive social motility and fruiting body organization. |
| *Pseudomonas aeruginosa* *P. aeruginosa* | Gram-negative rod. Frequent opportunistic pathogen and infects burn wounds. Causes ear infections in children. Infects the lungs of cystic fibrosis patients. |
| *Porphyromonas gingivalis* (*P. gingivalis*) | Non-motile, gram-negative, rod-shaped, anaerobic pathogenic bacterium (periodontal disease) |
| *Progeussmirabilis* (*P. mirabilis*) | Gram-negative, facultatively anaerobic bacterium. Causes 90% of all 'Proteus' infections in humans. |
| *S. epidermidis* (*S. epidermidis*) | Gram-positive, coagulase-negative cocci. Nosocomial pathogen associated with infection (biofilm) of implanted medical device. |

TABLE 2-continued

Illustrative target microorganisms and associated pathology.

| | |
|---|---|
| Streptococcus mutans (S. mutans) | Gram-positive, facultatively anaerobic bacterium commonly found in the human oral cavity and is a significant contributor to tooth decay |
| Streptococcus pneumoniae (S. pneumoniae) | Gram-positive, alpha-hemolytic, bile soluble aerotolerant anaerobe. Causal agent for streptococcal pneumonia. |
| Treponema denticola (T. denticola) | Gram-negative oral spirochete associated with the incidence and severity of human periodontal disease. |
| Trichophyton rubrum (T. rubrum) | Most common cause of athlete's foot, jock itch and ringworm. |

The various agents described herein (targeting peptides, compound targeting peptides, antimicrobial peptides (AMPs) and/or compound AMPs, STAMPs and/or other chimeric moieties). or compositions thereof, are useful as biocidal or biostatic or fungicidal or fungistatic agents and/or virucidal agents in a wide variety of applications. For example, the agents can be used to disinfect or preserve a variety of materials including medical instruments, foodstuffs, medicaments, cosmetics and other nutrient-containing materials. Various peptides described herein are particularly useful as bacteriostatic or bactericidal agents against multi-drug-resistant pathogens such as MRSA in a variety of clinical settings.

The agents described herein, or compositions thereof, are also useful for the prophylaxis or treatment of microbial infections and diseases related thereto in both plants and animals. Such diseases include, but are not limited to, Gram-negative and Gram-positive bacterial infections, endocarditis, pneumonia and other respiratory infections, urinary tract infections, systemic candidiasis, oral mucositis, fungal infections, biofilm formation or maintenance (e.g., on medical implants), and the like.

In various embodiments, the agents described herein can be formulated individually, in combination with each other, in combination with other antimicrobial peptides, and/or in combination with various antibiotic (e.g., antibacterial) agents in "home healthcare" formulations. Such formulations include, but are not limited to toothpaste, mouthwash, tooth whitening strips or solutions, contact lens storage, wetting, or cleaning solutions, dental floss, toothpicks, toothbrush bristles, oral sprays, oral lozenges, nasal sprays, aerosolizers for oral and/or nasal application, wound dressings (e.g., bandages), and the like.

Such applications are illustrative and not limiting. Using the teachings provided herein other uses of the AMPs and compositions described herein will be recognized by one of I. Targeting Peptides.

A) Uses of Targeting Peptides.

The novel microorganism-binding peptides (targeting peptides) described herein can be used to preferentially or specifically deliver an effector to a microorganism (e.g., a bacterium, a fungus, a protozoan, an algae, etc.), to a bacterial film, to a biofilm, and the like. The targeting peptides described herein can be used to bind to and thereby label particular targets, and/or as capture reagents to bind target microorganisms and thereby provide an indicator of the presence and/or quantity of the target microorganism(s). In certain embodiments the targeting peptide can be attached to an effector such as an epitope tag and/or a detectable label and thereby facilitate the identification of the presence and/or location, and/or quantity of the target (e.g., target organism). Thus targeting moieties are thus readily adapted for use in in vivo diagnostics, and/or ex vivo assays. Moreover, because of small size and good stability, microorganism binding peptides are well suited for microassay systems (e.g., microfluidic assays (Lab on a Chip), microarray assays, and the like).

In certain embodiments the microorganism binding peptides (targeting peptides) can be attached to an effector that has antimicrobial activity (e.g., an antimicrobial peptide, an antibacterial and/or antifungal, a vehicle that contains an antibacterial or antifungal, etc. In various embodiments these chimeric moieties can be used in vivo, or ex vivo to preferentially inhibit or kill the target organism(s).

In certain embodiments the targeting peptides can be recombinantly expressed as part of a yeast or phage tail fiber or coat protein to enhance binding of the yeast or phage to a specific bacterial Gram-designation, genus, species, or strain. Phage with expressed peptides will then display altered infection selectivity towards a designed target bacteria for use in phage therapy. Cloning the DNA encoding a peptide of interest into the major or minor coat proteins of a bacteriophage, for example in Proteins I through VIII of phages SAP-2, M13, or T7, will result in a targeted phage expressing 1-200 copies of the targeting peptide on the phage surface.

In certain embodiments the targeting peptides can be used in various pre-targeting protocols. In pre-targeting protocols, a chimeric molecule is utilized comprising a primary targeting species (e.g. a microorganism-binding peptide) that specifically binds the desired target (e.g. a bacterium) and an effector that provides a binding site that is available for binding by a subsequently administered second targeting species. Once sufficient accretion of the primary targeting species (the chimeric molecule) is achieved, a second targeting species comprising (i) a diagnostic or therapeutic agent and (ii) a second targeting moiety, that recognizes the available binding site of the primary targeting species, is administered.

An illustrative example of a pre-targeting protocol is the biotin-avidin system for administering a cytotoxic radionuclide to a tumor. In a typical procedure, a monoclonal antibody targeted against a tumor-associated antigen is conjugated to avidin and administered to a patient who has a tumor recognized by the antibody. Then the therapeutic agent, e.g., a chelated radionuclide covalently bound to biotin, is administered. The radionuclide, via its attached biotin is taken up by the antibody-avidin conjugate pretargeted at the tumor. Examples of pre-targeting biotin/avidin protocols are described, for example, in Goodwin et al., U.S. Pat. No. 4,863,713; Goodwin et al. (1988) *J. Nucl. Med.* 29: 226; Hnatowich et al. (1987) *J. Nucl. Med.* 28: 1294; Oehr et al. (1988) *J. Nucl. Med.* 29: 728; Klibanov et al. (1988) *J. Nucl. Med.* 29: 1951; Sinitsyn et al. (1989) *J. Nucl. Med.* 30: 66; Kalofonos et al. (1990) *J. Nucl. Med.* 31: 1791; Schechter et al. (1991) *Int. J. Cancer* 48:167; Paganelli et al. (1991) *Cancer Res.* 51: 5960; Paganelli et al. (1991) *Nucl. Med. Commun.* 12: 211; Stickney et al. (1991) *Cancer Res.* 51: 6650; and Yuan et al. (1991) *Cancer Res.* 51:3119.

It will be recognized that the tumor-specific antibody used for cancer treatments can be replaced with a microorganism binding peptide of the present invention and similar pre-targeting strategies can be used to direct labels, antibiotics, and the like to the target organism(s).

Three-step pre-targeting protocols in which a clearing agent is administered after the first targeting composition has localized at the target site also have been described. The clearing agent binds and removes circulating primary conjugate which is not bound at the target site, and prevents circulating primary targeting species (antibody-avidin or conjugate, for example) from interfering with the targeting of active agent species (biotin-active agent conjugate) at the target site by competing for the binding sites on the active agent-conjugate. When antibody-avidin is used as the primary targeting moiety, excess circulating conjugate can be cleared by injecting a biotinylated polymer such as biotinylated human serum albumin. This type of agent forms a high molecular weight species with the circulating avidin-antibody conjugate which is quickly recognized by the hepatobiliary system and deposited primarily in the liver.

Examples of these protocols are disclosed, e.g., in PCT Application No. WO 93/25240; Paganelli et al. (1991) Nucl. Med. Comm., 12: 211-234; Oehr et al. (1988) J. Nucl. Med., 29: 728-729; Kalofonos et al. (1990) J. Nucl. Med., 31: 1791-1796; Goodwin et al. (1988) J. Nucl. Med., 29: 226-234; and the like).

These applications of microorganism binding peptides of this invention are intended to be illustrative and not limiting. Using the teaching provided herein, other uses will be recognized by one of skill in the art.

B) Illustrative Novel Targeting Peptides.

In certain embodiments, the targeting moiety comprises one or more targeting peptides that bind particular bacteria, fungi, and/or yeasts, and/or algae, and/or viruses and/or that bind particular groups of bacteria, and/or groups of fungi, and/or groups of yeasts, and/or groups of algae.

In certain embodiments the targeting peptides include peptides comprising or consisting of one or more of the amino acid sequences shown in Table 3 (SEQ ID NOs:13-1566). In various embodiments the peptides include peptides comprising or consisting of the retro, inverso, retro-inverso, and/or beta form of one or more of the amino acid sequences shown in Table 3. Also contemplated are circular permutations of these sequences as well as peptides comprising or consisting of the retro, inverso, retro-inverso, and/or beta form of such circular permutations.

It will also be recognized, that in certain embodiments, any peptide or compound AMP described herein can be circularized.

In various embodiments the peptides can optionally bear one or more protecting groups, e.g., and the amino and/or carboxyl termini, and/or on side chains.

Also contemplated are peptides comprising one, two, three four, or five conservative substitutions of these amino acid sequences.

TABLE 3

Illustrative list of novel targeting peptides.

| ID | Target(s) | Targeting Peptide Sequence | SEQ ID NO |
|---|---|---|---|
| 1T-3 | S. mutans<br>S. gordonii | VLGIAGGLDAYGELVGGN | 13 |
| 1T-4 | S. mutans<br>S. gordonii<br>S. sanguinis<br>S. oxalis<br>V. atypica<br>L. casei | LDAYGELVGGN | 14 |
| 1T-6 | S. mutans | KFINGVLSQFVLERK | 15 |
| 1T-7 | M. xanthus | SQRIIEPVKSPQPYPGFSVS | 16 |
| 1T-8 | M. xanthus | FSVAACGEQRAVTFVLLIEDLI | 17 |
| 1T-9 | M. xanthus | WAWAESPRCVSTRSNIHALAFRVEVAALT | 18 |
| 1T-10 | M. xanthus | SPAGLPGDGDEA | 19 |
| 1T-11 | S. mutans<br>S. epidermidis<br>P. aeruginosa | RISE | 20 |
| 1T-12 | C. xerosis<br>C. striatum<br>S. epidermidis<br>S. mutans | FGNIFKGLKDVIETIVKWTAAK | 21 |
| 1T-13 | S. aureus<br>S. epidermidis<br>P. aeruginosa | FRSPCINNNSLQPPGVYPAR | 22 |
| 1T-14 | S. mutans<br>S. aureus<br>S. epidermidis<br>C. xerosis | ALAGLAGLISGK | 23 |
| 1T-15 | S. mutans | DVILRVEAQ | 24 |

TABLE 3-continued

Illustrative list of novel targeting peptides.

| ID | Target(s) | Targeting Peptide Sequence | SEQ ID NO |
|---|---|---|---|
| 1T-16 | P. aeruginosa | IDMR | 25 |
| 1T-17 | S. mutans | NNAIVYIS | 26 |
| 1T-18 | S. aureus<br>S. epidermidis<br>C. striatum<br>P. aeruginosa | YSKTLHFAD | 27 |
| 1T-19 | S. aureus<br>S. epidermidis<br>P. aeruginosa | PGAFRNPQMPRG | 28 |
| 1T-20 | S. mutans<br>P. aeruginosa | PALVDLSNKEAVWAVLDDHS | 29 |
| 1T-21 | S. mutans<br>P. aeruginosa | YVEEAVRAALKKEARISTEDTPVNLPSFDC | 30 |
| 1T-22 | S. epidermidis<br>P. aeruginosa | VPLDDGTRRPEVARNRDKDRED | 31 |
| 1T-23 | S. mutans<br>P. aeruginosa | PALVDLSNKEAVWAVLDDHS | 32 |
| 1T-24 | P. aeruginosa | EEAEEKLAEVSQAVKRLVR | 33 |
| 1T-25 | S. aureus<br>S. epidermidis<br>C. xerosis<br>C. striatum<br>P. aeruginosa | VGLDVSVLVLFFGLQLLSVLLGAMIR | 34 |
| 1T-26 | S. mutans<br>S. aureus<br>S. epidermidis<br>C. jeikeium<br>C. xerosis<br>C. striatum<br>P. aeruginosa | LTILPTTFFAIIVPILAVAFIAYSGFKIKGIVEHKDQW | 35 |
| 1T-27 | S. mutans<br>S. aureus<br>S. epidermidis<br>C. jeikeium<br>C. xerosis<br>C. striatum<br>P. aeruginosa | ALFVSLEQFLVVVAKSVFALCHSGTLS | 36 |
| 1T-28 | P. aeruginosa | VSRDEAMEFIDREWTTLQPAGKSHA | 37 |
| 1T-29 | S. mutans<br>S. aureus<br>S. epidermidis<br>C. jeikeium<br>C. xerosis<br>C. striatum<br>P. aeruginosa | GSVIKKRRKRMSKKKHRKMLRRTRVQRRKLGK | 38 |
| 1T-30 | S. aureus<br>S. epidermidis<br>C. xerosis<br>C. striatum<br>P. aeruginosa | GKAKPYQVRQVLRAVDKLETRRKKGGR | 39 |
| 1T-31 | S. mutans<br>P. aeruginosa | NATGTDIGEVTLTLGRFS | 40 |
| 1T-32 | S. mutans | VSFLAGWLCLGLAAWRLGNA | 41 |
| 1T-33 | S. aureus<br>S. epidermidis<br>C. jeikeium<br>C. xerosis | VRTLTILVIFIFNYLKSISYKLKQPFENNLAQSMISI | 42 |

TABLE 3-continued

Illustrative list of novel targeting peptides.

| ID | Target(s) | Targeting Peptide Sequence | SEQ ID NO |
|---|---|---|---|
| | C. striatum<br>P. aeruginosa | | |
| 1T-34 | S. aureus<br>S. epidermidis<br>C. jeikeium<br>C. xerosis<br>C. striatum<br>P. aeruginosa | AFWLNILLTLLGYIPGIVHAVYIIAKR | 43 |
| 1T-35 | P. aeruginosa | EICLTLVFPIRGSYSEAAKFPVPIHIVEDG<br>TVELPK | 44 |
| 1T-36 | S. aureus<br>S. epidermidis<br>C. jeikeium<br>C. xerosis<br>C. striatum<br>P. aeruginosa | VYRHLRFIDGKLVEIRLERK | 45 |
| 1T-37 | S. mutans<br>S. aereus<br>S. epidermidis<br>C. jeikeium<br>C. xerosis<br>C. striatum<br>P. aeruginosa | YIVGALVILAVAGLIYSMLRKA | 46 |
| 1T-38 | S. mutans<br>S. aereus<br>S. epidermidis<br>C. jeikeium<br>C. xerosis<br>C. striatum<br>P. aeruginosa | VMFVLTRGRSPRPMIPAY | 47 |
| 1T-39 | S. mutans<br>P. aeruginosa | FGFCVWMYQLLAGPPGPPA | 48 |
| 1T-40 | S. mutans<br>P. aeruginosa | QRVSLWSEVEHEFR | 49 |
| 1T-41 | S. mutans<br>S. aureus<br>S. epidermidis<br>C. jeikeium<br>C. striatum<br>P. aeruginosa | KRGSKIVIAIAVVLIVLAGVWVW | 50 |
| 1T-42 | S. aureus<br>S. epidermidis<br>C. xerosis<br>C. striatum<br>P. aeruginosa | TVLDWLSLALATGLFVYLLVALLRADRA | 51 |
| 1T-43 | C. jeikium<br>P. aeruginosa | DRCLSVLSWSPPKVSPLI | 52 |
| 1T-44 | S. mutans<br>S. aureus<br>S. epidermidis<br>C. jeikeium<br>C. striatum<br>P. aeruginosa | DPALADFAAGMRAQVRT | 53 |
| 1T-45 | S. aureus<br>S. epidermidis<br>C. striatum<br>P. aeruginosa | WTKPSFTDLRLGFEVTLYFANR | 54 |
| 1T-46 | S. aureus<br>S. epidermidis<br>C. jeikeium<br>C. xerosis | FSFKQRVMFRKEVERLR | 55 |

TABLE 3-continued

Illustrative list of novel targeting peptides.

| ID | Target(s) | Targeting Peptide Sequence | SEQ ID NO |
|---|---|---|---|
| | C. striatum<br>P. aeruginosa | | |
| 1T-47 | S. mutans<br>S. epidermidis<br>P. aeruginosa | VIKISVPGQVQMLIP | 56 |
| 1T-48 | S. aureus<br>S. epidermidis<br>C. jeikeium<br>C. xerosis<br>C. striatum<br>P. aeruginosa | KLQVHHGRATHTLLLQPPLCAPGTIR | 57 |
| 1T-49 | S. aureus<br>S. epidermidis<br>C. jeikeium<br>P. aeruginosa | SLVRIHDQQPWVTRGAFIDAARTCS | 58 |
| 1T-50 | P. aeruginosa | HSDEPIPNILFKSDSVH | 59 |
| 1T-51 | S. aureus<br>P. aeruginosa | GKPKRMPAEFIDGYGQALLAGA | 60 |
| 1T-52 | S. aureus<br>C. xerosis<br>P. aeruginosa | DEYPAKLPLSDKGATEPRRH | 61 |
| 1T-53 | P. aeruginosa | SDILAEMFEKGELQTLVKDAAAKANA | 62 |
| 1T-54 | S. epidermidis<br>C. xerosis<br>C. striatum<br>P. aeruginosa | RWVSCNPSWRIQ | 63 |
| 1T-55 | C. xerosis<br>P. aeruginosa | NHKTLKEWKAKWGPEAVESWATLLG | 64 |
| 1T-56 | C. xerosis<br>P. aeruginosa | LALIGAGIWMIRKG | 65 |
| 1T-57 | P. aeruginosa | RLEYRRLETQVEENPESGRRPMRG | 66 |
| 1T-58 | P. aeruginosa | CDDLHALERAGKLDALLSA | 67 |
| 1T-59 | S. aureus<br>S. epidermidis<br>P. aeruginosa | AVGNNLGKDNDSGHRGKKHRKHKHR | 68 |
| 1T-60 | S. aureus<br>S. epidermidis<br>C. jeikeium<br>C. striatum<br>P. aeruginosa | YLTSLGLDAAEQAQGLLTILKG | 69 |
| 1T-61 | P. aeruginosa | HATLLPAVREAISRQLLPALVPRG | 70 |
| 1T-62 | S. epidermidis<br>P. aeruginosa | GCKGCAQRDPCAEPEPYFRLR | 71 |
| 1T-63 | S. aureus<br>S. epidermidis<br>C. jeikeium<br>C. xerosis<br>C. striatum<br>P. aeruginosa | EPLILKELVRNLFLFCYARALR | 72 |
| 1T-64 | S. aureus<br>S. epidermidis<br>C. jeikeium<br>C. xerosis<br>C. striatum<br>P. aeruginosa | QTVHHIHMHVLGQRQMHWPPG | 73 |

TABLE 3-continued

Illustrative list of novel targeting peptides.

| ID | Target(s) | Targeting Peptide Sequence | SEQ ID NO |
|---|---|---|---|
| 1T-65 | S. mutans<br>S. aureus<br>S. epidermidis<br>C. jeikeium<br>C. xerosis<br>C. striatum<br>P. aeruginosa | HARAAVGVAELPRGAAVEVELIAAVRP | 74 |
| 1T-66 | S. mutans<br>S. aureus<br>S. epidermidis<br>C. jeikeium<br>C. xerosis<br>C. striatum<br>P. aeruginosa | DTDCLSRAYAQRIDELDKQYAGIDKPL | 75 |
| 1T-67 | S. aureus<br>S. epidermidis<br>C. jeikeium<br>C. xerosis<br>C. striatum<br>P. aeruginosa | GQRQRLTCGRVSGCSEGPSREAAR | 76 |
| 1T-68 | S. mutans<br>S. aureus<br>C. jeikeium<br>C. xerosis<br>C. striatum<br>P. aeruginosa | GGTKEIVYQRG | 77 |
| 1T-69 | S. mutans<br>P. aeruginosa | ILSQEADRKKLF | 78 |
| 1T-70 | S. aureus<br>C. jeikeium<br>P. aeruginosa | NRQAQGERAHGEQQG | 79 |
| 1T-71 | P. aeruginosa | KIDTNQWPPNKEG | 80 |
| 1T-72 | P. aeruginosa | EPTDGVACKER | 81 |
| 1T-73 | S. pneumoniae | GWWEELLHETILSKFKITKALELPIQL | 82 |
| 1T-74 | S. pneumoniae | DIDWGRKISCAAGVAYGAIDGCATTV | 83 |
| 1T-75 | S. pneumoniae | GVARGLQLGIKTRTQWGAATGAA | 84 |
| 1T-76 | S. pneumoniae | EMRLSKFFRDFILWRKK | 85 |
| 1T-77 | S. pneumoniae | EMRISRIILDFLFLRKK | 86 |
| 1T-78 | S. pneumoniae | FFKTIFVLILGALGVAAGLYIEKNYIDK | 87 |
| 1T-79 | S. pneumoniae | FGTPWSITNFWKKNFNDRPDFDSDRRRY | 88 |
| 1T-80 | S. pneumoniae | GGNLGPGFGVIIP | 89 |
| 1T-81 | S. pneumoniae | AIATGLDIVDGKFDGYLWA | 90 |
| 1T-82 | S. pneumoniae | FGVGVGIALFMAGYAIGKDLRKKFGKSC | 91 |
| 1T-83 | S. pneumoniae | QKPRKNETFIGYIQRYDIDGNGYQSLPCPQN | 92 |
| 1T-84 | S. pneumoniae | FRKKRYGLSILLWLNAFTNLVNSIHAFYMTLF | 93 |
| 1T-85 | A. naeslundii<br>F. nucleatum<br>P. gingivalis<br>S. epidermidis<br>S. gordonii<br>S. mitis<br>S. mutans | VMASLTWRMRAASASLPTHSRTDA | 94 |

TABLE 3-continued

Illustrative list of novel targeting peptides.

| ID | Target(s) | Targeting Peptide Sequence | SEQ ID NO |
|---|---|---|---|
| | S. oralis<br>S. salivarious<br>S. sanguinis | | |
| 1T-86 | S. mitis<br>S. oralis<br>S. salivarious | HRKNPVLGVGRRHRAHNVA | 95 |
| 1T-87 | S. mitis<br>S. mutans<br>S. oralis | EAVGQDLVDAHHP | 96 |
| 1T-89 | S. mitis<br>S. mutans | HEDDKRRGMSVEVLGFEVVQHEE | 97 |
| 1T-90 | S. gordonii<br>S. mitis<br>S. mutans<br>S. oralis<br>S. sanguinis | RNVIGQVL | 98 |
| 1T-91 | S. mitis<br>S. mutans<br>S. oralis<br>S. sanguinis | TSVRPGAAGAAVPAGAAGAAGAGWR<br>WP | 99 |
| 1T-92 | S. mitis<br>S. mutans | GQDEGQRRAGVGEGQGVDG | 100 |
| 1T-93 | S. epidermidis<br>S. gordonii<br>S. mitis<br>S. mutans<br>S. oralis<br>S. sanguinis | AMRSVNQA | 101 |
| 1T-94 | S. mitis<br>S. mutans<br>S. oralis | DQVAHSGDMLVQARRRDS | 102 |
| 1T-95 | S. gordonii<br>S. mitis<br>S. mutans<br>S. oralis<br>S. sanguinis | GHLLRVGGRVGGVGGVAGACAQPFGGQ | 103 |
| 1T-96 | S. gordonii<br>S. mitis<br>S. mutans<br>S. oralis<br>S. sanguinis | VAGACAQPFGGQ | 104 |
| 1T-97 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | GVAERNLDRITVAVAIIWTITIVGLGLV<br>AKLG | 105 |
| 1T-98 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | VRSAKAVKALTAAGYTGELVNVSGGM<br>KAWLGQ | 106 |

TABLE 3-continued

Illustrative list of novel targeting peptides.

| ID | Target(s) | Targeting Peptide Sequence | SEQ ID NO |
|---|---|---|---|
| 1T-99 | S. gordonii<br>S. mitis<br>S. mutans<br>S. oralis<br>S. sanguinis | MKAWLGQ | 107 |
| 1T-100 | S. gordonii<br>S. mitis<br>S. mutans | LDPLEPRIAPPGDRSHQGAPACHRDPLR<br>GRSARDAER | 108 |
| 1T-101 | A. naeslundii<br>P. gingivalis<br>S. epidermidis<br>S. gordonii<br>S. mitis<br>S. mutans<br>S. oralis<br>S. sanguinis | RLRVGRATDLPLTSFAVGVVRNLPDAP<br>AH | 109 |
| 1T-102 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | WKRLWPARILAGHSRRRMRWMVVWR<br>YFAAT | 110 |
| 1T-103 | A. naeslundii<br>F. nucleatum<br>P. gingivalis<br>S. epidermidis<br>S. gordonii<br>S. mitis<br>S. mutans<br>S. oralis<br>S. sanguinis | AQFYEAIITGYALGAGQRIGQL | 111 |
| 1T-104 | S. mitis | RAVAAHLQGRHHGHQVRRQRHGQR | 112 |
| 1T-105 | S. epidermidis<br>S. gordonii<br>S. mitis<br>S. mutans<br>S. oralis | GEGLPPPVLHLPPPRMSGR | 113 |
| 1T-106 | S. gordonii<br>S. mitis<br>S. mutans<br>S. oralis<br>S. salivarious | DALRRSRSQGRRHR | 114 |
| 1T-107 | A. naeslundii<br>S. epidermidis<br>S. gordonii<br>S. mitis<br>S. mutans<br>S. oralis<br>S. salivarious<br>S. sanguinis | SPVPRFTAVGGVSRGSP | 115 |
| 1T-108 | S. gordonii<br>S. mitis<br>S. mutans<br>S. oralis<br>S. salivarious<br>S. sanguinis | WGPLGPERPLW | 116 |
| 1T-109 | A. naeslundii<br>S. epidermidis<br>S. gordonii<br>S. mitis | VTTNVRQGAGS | 117 |

TABLE 3-continued

Illustrative list of novel targeting peptides.

| ID | Target(s) | Targeting Peptide Sequence | SEQ ID NO |
|---|---|---|---|
| | S. mutans<br>S. oralis<br>S. salivarious<br>S. sanguinis | | |
| 1T-110 | A. naeslundii<br>P. gingivalis<br>S. epidermidis<br>S. gordonii<br>S. mitis<br>S. mutans<br>S. oralis<br>S. sanguinis | LAAKTAVCVGRAFM | 118 |
| 1T-111 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | GRLSRREEDPATSIILLRGAYRMAVF | 119 |
| 1T-112 | S. gordonii | SDNDGKLILGTSQ | 120 |
| 1T-113 | S. mitis | HGAHQRTGQRLHHHRGRTVSGCRQNPVAGVDPDEHR | 121 |
| 1T-114 | A. naeslundii<br>P. gingivalis<br>S. epidermidis<br>S. gordonii<br>S. mitis<br>S. mutans<br>S. oralis<br>S. sanguinis | RQAPGPGLVTITAACSAPGSRSR | 122 |
| 1T-115 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | LLIERFSNHH | 123 |
| 1T-116 | A. naeslundii<br>P. gingivalis<br>S. epidermidis<br>S. gordonii<br>S. mitis<br>S. mutans<br>S. oralis<br>S. salivarious<br>S. sanguinis | MILHRRRDR | 124 |
| 1T-117 | S. mutans | GPGVVGPAPFSRLPAHALNL | 125 |
| 1T-118 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | TASPPAPSDQGLRTAFPATLLIALAALARISR | 126 |
| 1T-119 | S. gordonii<br>S. mitis | SPATQKAPTRAQPSRAPVQDCGDGRPTAAPDDVERLSPR | 127 |

TABLE 3-continued

Illustrative list of novel targeting peptides.

| ID | Target(s) | Targeting Peptide Sequence | SEQ ID NO |
|---|---|---|---|
| | S. mutans<br>S. oralis | | |
| 1T-120 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | DVRDRVDLAGADLCAAHATR | 128 |
| 1T-121 | S. gordonii<br>S. mitis<br>S. mutans<br>S. oralis<br>S. salivarious<br>S. sanguinis | FAKETGFGIGGAQEGWWIIADIYGPNPF | 129 |
| 1T-122 | S. mitis | GAIPDPVTHRVDWEEDHQTRPSR | 130 |
| 1T-123 | S. gordonii | LVRRNAVAGRSDGLAGAEQLDLVRLQGVL | 131 |
| 1T-124 | S. mitis<br>S. mutans<br>S. oralis | LFDERNKIA | 132 |
| 1T-125 | S. epidermidis<br>S. gordonii<br>S. mutans<br>S. oralis | DAITGGNPPLSDTDGLRP | 133 |
| 1T-126 | S. gordonii<br>S. mitis<br>S. mutans | QGLARPVLRRIPL | 134 |
| 1T-127 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | YDPVPKRKNKNSEGKREE | 135 |
| 1T-128 | A. naeslundii<br>P. gingivalis<br>S. epidermidis<br>S. gordonii<br>S. mitis<br>S. mutans<br>S. oralis<br>S. salivarious<br>S. sanguinis | SGSAIRMLEIATKMLKR | 136 |
| 1T-129 | A. naeslundii<br>P. gingivalis<br>S. epidermidis<br>S. gordonii<br>S. mitis<br>S. mutans<br>S. oralis<br>S. salivarious<br>S. sanguinis | YDKYIKYLSIQPPFIVYFI | 137 |
| 1T-130 | A. naeslundii<br>F. nucleatum<br>P. gingivalis<br>S. epidermidis<br>S. gordonii | QKIIDMSKFLFSLILFIMIVVIYIGKSIGGYSAIVSSIMLELDTVLYNKKIFFIYK | 138 |

TABLE 3-continued

Illustrative list of novel targeting peptides.

| ID | Target(s) | Targeting Peptide Sequence | SEQ ID NO |
|---|---|---|---|
| | S. mitis<br>S. mutans<br>S. oralis<br>S. salivarious<br>S. sanguinis | | |
| 1T-131 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | DEVWKMLGI | 139 |
| 1T-132 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | YSKKLFEYFYFIIFILIRYLIFYKIIQNKNY YINNIAYN | 140 |
| 1T-133 | A. naeslundii<br>P. gingivalis<br>S. epidermidis<br>S. gordonii<br>S. mitis<br>S. mutans<br>S. oralis<br>S. salivarious<br>S. sanguinis | YFIKDDNEALSKDWEVIGNDLKGTIDK YGKEFKVR | 141 |
| 1T-134 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | SRLVREIKKKCRKS | 142 |
| 1T-135 | A. naeslundii<br>P. gingivalis<br>S. epidermidis<br>S. gordonii<br>S. mitis<br>S. mutans<br>S. oralis<br>S. salivarious<br>S. sanguinis | FESLLPQATKKIVNNKGSKINKIF | 143 |
| 1T-136 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | ELLTQIRLALLYSVNEW | 144 |
| 1T-137 | A. naeslundii<br>F. nucleatum<br>P. gingivalis<br>S. epidermidis<br>S. gordonii | PLNFYRAVKENRLPLSEKNINDFTNIKL KVSPKLINLLQESSIFYNFSPKKRNTN | 145 |

TABLE 3-continued

Illustrative list of novel targeting peptides.

| ID | Target(s) | Targeting Peptide Sequence | SEQ ID NO |
|---|---|---|---|
| | S. mitis<br>S. mutans<br>S. oralis<br>S. salivarious<br>S. sanguinis | | |
| 1T-138 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | YPNEYCIFLENLSLEELKEIKAINGETLN<br>LEEIINERKNLKD | 146 |
| 1T-139 | A. naeslundii<br>S. gordonii<br>S. mitis<br>S. mutans<br>S. oralis | AVAGAAVGALLGNDARSTAVGAAIGG<br>ALGAGAGELTKNK | 147 |
| 1T-140 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | IKGTIAFVGEDYVEIRVDKGVKLTFRKS<br>AIANVINNNQQ | 148 |
| 1T-141 | F. nucleatum<br>P. gingivalis<br>S. epidermidis<br>S. gordonii<br>S. mitis<br>S. mutans<br>S. oralis<br>S. sanguinis | KKFIILLFILVQGLIFSATKTLSDIIAL | 149 |
| 1T-142 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | FTQGIKRIVLKRLKED | 150 |
| 1T-143 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | MPKRHYYKLEAKALQFGLPFAYSPIQL<br>LK | 151 |
| 1T-144 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | IIELHPKSWTQDWRCSFL | 152 |

TABLE 3-continued

Illustrative list of novel targeting peptides.

| ID | Target(s) | Targeting Peptide Sequence | SEQ ID NO |
|---|---|---|---|
| 1T-145 | S. mitis<br>S. mutans<br>S. oralis | VEAGKRNISLENIEKISKGLGISISELFKY<br>IEEGEDKIG | 153 |
| 1T-146 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | RNSADNQTKIDKIRIDISLWDEHLNIVK<br>QGK | 154 |
| 1T-147 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | GVENRRFYERDVSKVSMMTSEAVAPR<br>GGSK | 155 |
| 1T-148 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | IVELDDTTILERALSMLGEANA | 156 |
| 1T-149 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | SVRAVKPIDETVARHFPGDFIVN | 157 |
| 1T-150 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | YINRRLKKAFSDADIKEAPAEFYEELRR<br>VQYV | 158 |
| 1T-151 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | SVRAVKPIDEIVAWHFPGDFIVN | 159 |
| 1T-152 | A. naeslundii<br>F. nucleatum<br>P. gingivalis<br>S. epidermidis<br>S. gordonii | YVSADESAYNHIVTDDIPLADRRIEAVQQ | 160 |

TABLE 3-continued

Illustrative list of novel targeting peptides.

| ID | Target(s) | Targeting Peptide Sequence | SEQ ID NO |
|---|---|---|---|
| | S. mitis<br>S. mutans<br>S. oralis<br>S. salivarious<br>S. sanguinis | | |
| 1T-153 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | YIACPGYFY | 161 |
| 1T-154 | P. gingivalis | YFSFLEIVGMARR | 162 |
| 1T-155 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | LKLAFGVYPFQAMSQSDTAVSERNVLWR | 163 |
| 1T-156 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | GRFQISIRGEEKSKVKVQGKGTFTDRNTT | 164 |
| 1T-157 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | RRFRKTTENREKSKNKKAVLGLSTTSTASY | 165 |
| 1T-158 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | WENKPSPLGSIKKLQGLVYRLIGYRHFWV | 166 |
| 1T-159 | P. gingivalis | IFSLHHFALICSEMGTFAVSKRAKYKWEVL | 167 |
| 1T-160 | A. naeslundii<br>F. nucleatum<br>P. gingivalis<br>T. denticola<br>S. gordonii<br>S. mitis<br>S. mutans<br>S. oralis | AQYKYINKLLN | 168 |

TABLE 3-continued

Illustrative list of novel targeting peptides.

| ID | Target(s) | Targeting Peptide Sequence | SEQ ID NO |
|---|---|---|---|
| | S. salivarious<br>S. sanguinis | | |
| 1T-161 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | NKVLQVEVMWDGSVVGRPAGVISIKSSKKG | 169 |
| 1T-162 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | QKAKEESDRKAAVSYNGFHRVNVVSIPK | 170 |
| 1T-163 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | MENILIYIPMVLSPFGSGILLFLGKDRRYML | 171 |
| 1T-164 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | KKSHSQGKRKLKDLNSAYKIDNQLHYALR | 172 |
| 1T-165 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | CYDSFDFSIFVTFANRMKLSVGS | 173 |
| 1T-166 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | AQSAGQIKRKSKVRIHV | 174 |
| 1T-167 | A. naeslundii<br>F. nucleatum<br>P. gingivalis<br>S. epidermidis<br>S. gordonii<br>S. mitis | SRMSEHSPAGLVFEVGPMDKGSFIILDSYHPTVKK | 175 |

TABLE 3-continued

Illustrative list of novel targeting peptides.

| ID | Target(s) | Targeting Peptide Sequence | SEQ ID NO |
|---|---|---|---|
| | S. mutans<br>S. oralis<br>S. salivarious<br>S. sanguinis | | |
| 1T-168 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | ELHRIMSTEKIGAVTKMNFDTAPIMSILP<br>IDIYPKEVGIGS | 176 |
| 1T-169 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | FARVRRLHQNRILTQPLTNLKYCLRQPI<br>YSD | 177 |
| 1T-170 | P. gingivalis | AYGKVFSMDIMLSENDKLIVLRISHHSA<br>WH | 178 |
| 1T-171 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | SVRAVKPIDKTVARHFPGDFIVN | 179 |
| 1T-172 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | FEGLKNLLGDDII | 180 |
| 1T-173 | A. naeslundii<br>F. nucleatum<br>P. gingivalis<br>S. gordonii<br>S. mitis<br>S. mutans<br>S. oralis<br>S. salivarious<br>S. sanguinis | LFRKEDQEHVLL | 181 |
| 1T-174 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | SGGSDTDGSSSGEPGSHSGDL | 182 |
| 1T-175 | A. naeslundii<br>F. nucleatum | GEPGSHSGDL | 183 |

TABLE 3-continued

Illustrative list of novel targeting peptides.

| ID | Target(s) | Targeting Peptide Sequence | SEQ ID NO |
|---|---|---|---|
| | P. gingivalis<br>S. epidermidis<br>S. gordonii<br>S. mitis<br>S. mutans<br>S. oralis<br>S. salivarious<br>S. sanguinis | | |
| 1T-176 | A. naeslundii<br>P. gingivalis<br>S. epidermidis<br>S. gordonii<br>S. mitis<br>S. mutans<br>S. oralis<br>S. salivarious<br>S. sanguinis | PVGDIMSGFLRGANQPRFLLDHISFGS | 184 |
| 1T-177 | P. gingivalis<br>S. gordonii<br>S. mitis<br>S. mutans<br>S. oralis<br>S. salivarious<br>S. sanguinis | GTNVPTQILGYSREERFDYEPAPEQR | 185 |
| 1T-178 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | LLASHPERLSLGVFFVYRVLHLLLENT | 186 |
| 1T-179 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | TCYPLIQRKTDRAYEA | 187 |
| 1T-180 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | VVFGGGDRLV | 188 |
| 1T-181 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | YGKESDP | 189 |
| 1T-182 | A. naeslundii<br>F. nucleatum<br>P. gingivalis<br>T. denticola | LTASICRQWNDNSTPYQR | 190 |

TABLE 3-continued

Illustrative list of novel targeting peptides.

| ID | Target(s) | Targeting Peptide Sequence | SEQ ID NO |
|---|---|---|---|
| | S. gordonii<br>S. mitis<br>S. mutans<br>S. oralis<br>S. salivarious<br>S. sanguinis | | |
| 1T-183 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | PLRSFVAEKAEHAFRVVRIADFDFGHS | 191 |
| 1T-184 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | ALLVLNLLLMQFFFGKNM | 192 |
| 1T-185 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | HYHFLLEFGFHKGDYLE | 193 |
| 1T-188 | S. sanguinis | HRKDVYKK | 194 |
| 1T-190 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | IQIIVNAFVEKDKTGAVIEVLYASNNHE<br>KVKAKYEELVAIS | 195 |
| 1T-192 | S. sanguinis | ILVLLALQVELDSKFQY | 196 |
| 1T-193 | S. sanguinis | LMIFDKHANLKYKYGNRSFGVEAIM | 197 |
| 1T-195 | S. mutans | AASGFTYCASNGVWHPY | 198 |
| 1T-196 | F. nucleatum<br>S. sanguinis | KPEKEKLDTNTLMKVVNKALSLFDRLL<br>IKFGA | 199 |
| 1T-197 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | TEILNFLITVCADRENWKIKHGLSDSVL<br>LIFFARFTGAEYW | 200 |
| 1T-198 | P. gingivalis<br>S. epidermidis | MPVSKKRYMLSSAYATALGICYGQVAT<br>DEKESEITAIPDLLDYLSVEEYLL | 201 |

TABLE 3-continued

Illustrative list of novel targeting peptides.

| ID | Target(s) | Targeting Peptide Sequence | SEQ ID NO |
|---|---|---|---|
| | S. gordonii<br>S. mitis<br>S. mutans<br>S. oralis<br>S. sanguinis | | |
| 1T-199 | S. sanguinis | RAGRIKKLSQKEAEPFEN | 202 |
| 1T-200 | A. naeslundii<br>F. nucleatum<br>S. epidermidis<br>S. gordonii<br>S. mitis<br>S. mutans<br>S. oralis<br>S. salivarious<br>S. sanguinis | MRFKRFDRDYALSGDNVFEVLTASCDV<br>IERNLSYREMCGLMQ | 203 |
| 1T-201 | S. sanguinis | KRKHENVIVAEEMRVIKN | 204 |
| 1T-202 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | LCRLEKLCKQFLRQDKVVTYYLMLPYK<br>RAIEAFYQELKERS | 205 |
| 1T-203 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | YPFCLATVDHLPEGLSVTDYERVQRLV<br>SQFLLNKEER | 206 |
| 1T-207 | F. nucleatum<br>S. sanguinis | SPLEKYGTGSMTALTFLLGCCLLVLSKK<br>SR | 207 |
| 1T-208 | Unanalyzed | KRKRWAILTLFLAGLGAVGIVLATF | 208 |
| 1T-215 | S. sanguinis | VCFKDISVFLSPFRGQEVLFCGKAKHSL<br>IYVIGT | 209 |
| 1T-216 | S. sanguinis | FFLNVIAIRIPHF | 210 |
| 1T-217 | F. nucleatum<br>S. sanguinis | MLSNVLSRSVVSPNVDIPNSMVILSPLLI<br>SISNYH | 211 |
| 1T-218 | F. nucleatum<br>S. sanguinis | KLIFAALGLVFLLIGLRDSRSK | 212 |
| 1T-219 | S. sanguinis | RNINVSATFITEKSLV | 213 |
| 1T-221 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | DIGRIIGKKGRTITAIRSIVYSVPTQGKK<br>VRLVIDEK | 214 |
| 1T-222 | F. nucleatum<br>S. sanguinis | RIEASLISAIMFSMFNAIVKFLQK | 215 |

TABLE 3-continued

Illustrative list of novel targeting peptides.

| ID | Target(s) | Targeting Peptide Sequence | SEQ ID NO |
|---|---|---|---|
| 1T-223 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | NQKMEINSMTSEKEKMLAGHFHNEAN<br>FAVIFKYSLFYNFF | 216 |
| 1T-225 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | RRSLGNSASFAEWIEYIRYLHYIIRVQFI<br>HFFSKNKKI | 217 |
| 1T-226 | A. naeslundii<br>F. nucleatum<br>S. epidermidis<br>S. gordonii<br>S. mitis<br>S. mutans<br>S. oralis<br>S. salivarious<br>S. sanguinis | KLQEKQIDRNFERVSGYSTYRAVQAAK<br>AKEKGFISLEN | 218 |
| 1T-228 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | IFKLFEEHLLYLLDAFYYSKIFRRLKQGL<br>YRRKEQPYTQDLFRM | 219 |
| 1T-230 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | EFLEKFKVLKQPRKANNISKNRVAMIFL<br>TIHKSRGFLSSPY | 220 |
| 1T-233 | A. naeslundii<br>P. gingivalis<br>S. epidermidis<br>S. gordonii<br>S. mitis<br>S. mutans<br>S. oralis<br>S. salivarious<br>S. sanguinis | TDQELEHLIVTELESKRLDFTYSKDITEF<br>FDEAFPEYDQNY | 221 |
| 1T-234 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | DNFYLILKMEERGKSKKTSQTRGFRAFF<br>DIIRKKIKKEDGK | 222 |

TABLE 3-continued

Illustrative list of novel targeting peptides.

| ID | Target(s) | Targeting Peptide Sequence | SEQ ID NO |
|---|---|---|---|
| 1T-237 | S. sanguinis | EDPVPNHFTLRRNKKEKPSKS | 223 |
| 1T-238 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | IFNRRKFFQYFGLSKEAMVEHIQPFILDI<br>WQIHLF | 224 |
| 1T-239 | A. naeslundii<br>S. gordonii<br>S. mitis<br>S. mutans<br>S. oralis<br>S. sanguinis | ADDLLNKRLTDLIMENAETVKTIDLDN<br>SD | 225 |
| 1T-240 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | VILGNGISNIAQTLGQLPNIAWVWIYMV<br>LIAALLEESNVC | 226 |
| 1T-242 | F. nucleatum<br>S. sanguinis | KQVQNTTLIICGTVLLGILFKSYLKSQKSV | 227 |
| 1T-243 | A. naeslundii<br>P. gingivalis<br>S. epidermidis<br>S. gordonii<br>S. mitis<br>S. mutans<br>S. oralis<br>S. salivarious<br>S. sanguinis | SENIARFAAAFENEQVVSYARWFRRSW<br>RGSGSSSRF | 228 |
| 1T-248 | S. sanguinis | IGGALNSCG | 229 |
| 1T-249 | F. nucleatum<br>S. sanguinis | VFSVLKHTTWPTRKQSWHDFISILEYSA<br>FFALVIFIFDKLLTLGLAELLKRF | 230 |
| 1T-250 | S. mitis<br>S. mutans<br>S. oralis | LVQGDTILIENHVGTPVKDDGKDCLIIR<br>EADVLAVVND | 231 |
| 1T-252 | F. nucleatum<br>S. sanguinis | MKKNLKRFYALVLGFIIGCLFVSILIFIGY | 232 |
| 1T-253 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | KTKESLTQQEKKFLKDYDRKSLHHFRD<br>ILTYCFILDKLTNK | 233 |
| 1T-256 | S. sanguinis | KGKSLMPLLKQINQWGKLYL | 234 |
| 1T-257 | A. naeslundii<br>F. nucleatum<br>P. gingivalis<br>S. epidermidis<br>S. gordonii | IILAKAADLAEIERIISEDPFKINEIANYDI<br>IEFCPTKSSKAFEKVLK | 235 |

TABLE 3-continued

Illustrative list of novel targeting peptides.

| ID | Target(s) | Targeting Peptide Sequence | SEQ ID NO |
|---|---|---|---|
| | S. mitis<br>S. mutans<br>S. oralis<br>S. salivarious<br>S. sanguinis | | |
| 1T-258 | A. naeslundii<br>F. nucleatum<br>P. gingivalis<br>T. denticola<br>S. mitis<br>S. mutans<br>S. oralis | TINIDDKVLDYLKKINSKAITIDLIGCAS | 236 |
| 1T-259 | F. nucleatum<br>P. gingivalis<br>T. denticola<br>S. mitis<br>S. mutans<br>S. oralis<br>S. sanguinis | EKLKKILLKLAVCGKAWYTL | 237 |
| 1T-260 | A. naeslundii<br>P. gingivalis<br>S. epidermidis<br>S. gordonii<br>S. mitis<br>S. mutans<br>S. oralis<br>S. sanguinis | NILYFIHDENQWEPQKAEIFRGSIKHCA<br>WLSS | 238 |
| 1T-261 | F. nucleatum<br>S. mutans<br>S. oralis<br>S. sanguinis | SFEKNKIENNLKIAQAYIYIKPKPRICQA | 239 |
| 1T-262 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | LSLPLIVLTKSI | 240 |
| 1T-263 | A. naeslundii<br>F. nucleatum<br>P. gingivalis<br>S. epidermidis<br>S. gordonii<br>S. mitis<br>S. oralis<br>S. salivarious<br>S. sanguinis | FIAVSFTGNPATFKLVIGCKADN | 241 |
| 1T-264 | S. sanguinis | LEGKFYMAEDFDKTPECFKDYV | 242 |
| 1T-265 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | GMFENLLMINFQIMNDLKIEIVVKDRIC<br>AV | 243 |
| 1T-266 | S. sanguinis | RAGTWLVVDEIR | 244 |
| 1T-267 | A. naeslundii<br>F. nucleatum<br>P. gingivalis | RIKEERKNRSYKFFIWRLFDEKTGFI | 245 |

TABLE 3-continued

Illustrative list of novel targeting peptides.

| ID | Target(s) | Targeting Peptide Sequence | SEQ ID NO |
|---|---|---|---|
| | T. denticola<br>S. mitis<br>S. mutans<br>S. oralis<br>S. sanguinis | | |
| 1T-268 | F. nucleatum<br>S. mutans<br>S. oralis<br>S. sanguinis | PITPKKEKCGLGTYAPKNPVFSKSRV | 246 |
| 1T-269 | F. nucleatum<br>S. mutans<br>S. oralis<br>S. sanguinis | PLYVAAVEKINTAKKH | 247 |
| 1T-270 | F. nucleatum<br>S. mutans<br>S. oralis<br>S. sanguinis | VHEFDIQKILQNR | 248 |
| 1T-271 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | FLIQKFLLIKTFPPYRKKYVVIVSQTGTA | 249 |
| 1T-272 | F. nucleatum<br>S. mutans<br>S. oralis<br>S. sanguinis | QLAPIDKQLKAVKKIAFYESESTAAKAV<br>TVA | 250 |
| 1T-273 | F. nucleatum<br>P. gingivalis<br>T. denticola<br>S. mitis<br>S. mutans<br>S. oralis | YNEPNYKWLESYKIYKQRCEDRTGMY<br>YTEET | 251 |
| 1T-274 | F. nucleatum<br>S. mutans<br>S. oralis<br>S. sanguinis | ETTTEINAIKLHRIKQRSPQGTRRVN | 252 |
| 1T-275 | A. naeslundii<br>F. nucleatum<br>P. gingivalis<br>T. denticola<br>S. epidermidis<br>S. gordonii<br>S. mitis<br>S. mutans<br>S. oralis<br>S. salivarious<br>S. sanguinis | QVLKNFSISRRYKINNPFFKILLFIQLRTL | 253 |
| 1T-276 | A. naeslundii<br>F. nucleatum<br>P. gingivalis<br>S. epidermidis<br>S. gordonii<br>S. mitis<br>S. mutans<br>S. oralis<br>S. sanguinis | ILTLLILGSIGFFILKIKLKLGRF | 254 |
| 1T-277 | A. naeslundii<br>F. nucleatum<br>P. gingivalis<br>T. denticola | IYYMRFVNKPLEKTFFKI | 255 |

TABLE 3-continued

Illustrative list of novel targeting peptides.

| ID | Target(s) | Targeting Peptide Sequence | SEQ ID NO |
|---|---|---|---|
| | S. gordonii<br>S. mitis<br>S. mutans<br>S. oralis<br>S. salivarious<br>S. sanguinis | | |
| 1T-278 | A. naeslundii<br>F. nucleatum<br>P. gingivalis<br>S. gordonii<br>S. mitis<br>S. mutans<br>S. oralis<br>S. salivarious<br>S. sanguinis | SINSSAGIQPHCLSSSFVLRTKHCFY | 256 |
| 1T-279 | A. naeslundii<br>F. nucleatum<br>P. gingivalis<br>S. gordonii<br>S. mitis<br>S. mutans<br>S. oralis<br>S. salivarious<br>S. sanguinis | FVLRTKHCFY | 257 |
| 1T-280 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | TNNKNKVIIKAIKFKNKDFINLDLFIYRR | 258 |
| 1T-281 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | KYEKLTKENLFIRNSGNMCVFIYFLFFG | 259 |
| 1T-282 | F. nucleatum<br>P. gingivalis<br>S. gordonii<br>S. mitis<br>S. mutans<br>S. oralis<br>S. salivarious<br>S. sanguinis | ISLVFPAYT | 260 |
| 1T-283 | A. naeslundii<br>F. nucleatum<br>P. gingivalis<br>T. denticola<br>S. epidermidis<br>S. gordonii<br>S. mitis<br>S. mutans<br>S. oralis<br>S. salivarious<br>S. sanguinis | LCTKLEDKQRGRIPAELFIISPIKILERND<br>AL | 261 |
| 1T-284 | A. naeslundii<br>F. nucleatum<br>P. gingivalis<br>S. gordonii<br>S. mitis | FQYYFSLKRV | 262 |

TABLE 3-continued

Illustrative list of novel targeting peptides.

| ID | Target(s) | Targeting Peptide Sequence | SEQ ID NO |
|---|---|---|---|
| | S. mutans<br>S. oralis<br>S. salivarious<br>S. sanguinis | | |
| 1T-285 | A. naeslundii<br>F. nucleatum<br>P. gingivalis<br>S. gordonii<br>S. mitis<br>S. mutans<br>S. oralis<br>S. salivarious<br>S. sanguinis | FFPYYLADFYKQLKFLNEYQTKNKDKV<br>VEFK | 263 |
| 1T-286 | S. sanguinis | LGFFNNKADLVKADTERDNRMSSLKIK<br>DL | 264 |
| 1T-287 | P. gingivalis<br>T. denticola<br>S. gordonii<br>S. mitis<br>S. mutans<br>S. oralis<br>S. salivarious<br>S. sanguinis | KGYPLPFQYRLNNH | 265 |
| 1T-288 | F. nucleatum<br>S. gordonii<br>S. salivarious<br>S. sanguinis | RWVGGEPSADIYLSAKDTKT | 266 |
| 1T-289 | F. nucleatum<br>P. gingivalis<br>S. gordonii<br>S. mitis<br>S. mutans<br>S. oralis<br>S. sanguinis | EPSADIYLSAKDTKT | 267 |
| 1T-290 | A. naeslundii<br>F. nucleatum<br>P. gingivalis<br>S. gordonii<br>S. mitis<br>S. mutans<br>S. oralis<br>S. salivarious<br>S. sanguinis | IINQLNLILLRLMEILIL | 268 |
| 1T-291 | A. naeslundii<br>F. nucleatum<br>P. gingivalis<br>T. denticola<br>S. mitis<br>S. mutans<br>S. oralis | DMKIIKLYIKILSFLFIKYCNKKLNSVKL<br>KA | 269 |
| 1T-292 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | IINQLNLILLRLMEILIL | 270 |
| 1T-293 | A. naeslundii<br>F. nucleatum<br>P. gingivalis<br>S. epidermidis<br>S. gordonii<br>S. mitis | HVEDCFLLSNARTTAIHGRANPARGEPR<br>TRSE | 271 |

TABLE 3-continued

Illustrative list of novel targeting peptides.

| ID | Target(s) | Targeting Peptide Sequence | SEQ ID NO |
|---|---|---|---|
| | S. mutans<br>S. oralis<br>S. salivarious<br>S. sanguinis | | |
| 1T-294 | T. denticola | YDKIADGVFKIGKRGVL | 272 |
| 1T-295 | S. mitis<br>S. salivarious<br>S. sanguinis | KYKLKKIIL | 273 |
| 1T-296 | A. naeslundii<br>F. nucleatum<br>P. gingivalis<br>S. gordonii<br>S. mitis<br>S. mutans<br>S. oralis<br>S. salivarious<br>S. sanguinis | EYSQQSFKAKPCSERGVLSP | 274 |
| 1T-297 | A. naeslundii<br>F. nucleatum<br>T. denticola<br>S. mitis<br>S. mutans<br>S. oralis | RSLRLNNALTKLPKLWYNRIKEAFYAY<br>NDYDK | 275 |
| 1T-298 | A. naeslundii<br>F. nucleatum<br>P. gingivalis<br>T. denticola<br>S. gordonii<br>S. mitis<br>S. mutans<br>S. oralis<br>S. salivarious<br>S. sanguinis | ILNKKPKLPLWKLGKNYFRRFYVLPTFLA | 276 |
| 1T-299 | A. naeslundii<br>F. nucleatum<br>S. epidermidis<br>S. gordonii<br>S. mitis<br>S. mutans<br>S. oralis<br>S. salivarious<br>S. sanguinis | SMLTSFLRSKNTRSLKMYKDVHF | 277 |
| 1T-300 | A. naeslundii<br>F. nucleatum<br>P. gingivalis<br>S. epidermidis<br>S. gordonii<br>S. mitis<br>S. mutans<br>S. oralis<br>S. salivarious<br>S. sanguinis | PLIISKAQIKMSGDILGSCFKLFYLRPFF | 278 |
| 1T-301 | F. nucleatum<br>S. gordonii<br>S. sanguinis | SKLPRVLDASLKL | 279 |
| 1T-302 | A. naeslundii<br>P. gingivalis<br>S. epidermidis<br>S. gordonii<br>S. mitis<br>S. mutans<br>S. oralis<br>S. salivarious<br>S. sanguinis | IIIILPKIYLVCKTV | 280 |

TABLE 3-continued

Illustrative list of novel targeting peptides.

| ID | Target(s) | Targeting Peptide Sequence | SEQ ID NO |
|---|---|---|---|
| 1T-303 | A. naeslundii<br>F. nucleatum<br>P. gingivalis<br>S. gordonii<br>S. mitis<br>S. mutans<br>S. oralis<br>S. salivarious<br>S. sanguinis | LDYENMDCKKRIRI | 281 |
| 1T-304 | P. gingivalis | STAGEASRRTASEASRRTAAKLRG | 282 |
| TT-305 | F. nucleatum | ARNALNMRDVPVDAAIIGIIDGMDEE | 283 |
| TT-306 | F. nucleatum | KILNEAEGKLLKVIEKNGEIDIEEI | 284 |
| TT-307 | F. nucleatum | NGDKKAKEELDKWDEVIKELNIQF | 285 |
| TT-308 | F. nucleatum | GLVIIPNLIALIILFSQVRQQTKDYFSNPKLSSR | 286 |
| TT-309 | F. nucleatum | EPLPLTKYDKKDTEMKKVFKEILAGKVGYEKEEE | 287 |
| TT-310 | F. nucleatum | TKLKKNNKLLSAKKENTLHTKDK | 288 |
| TT-311 | S. mutans<br>S. sobrinus | AIFDAMHNL | 289 |
| PVCFBP2461 | P. fluorescens | DLys-Dorn-Gly-DThr-Thr-Gln-Gly-DSer-cDOrn | 290 |
| CHA0 | P. fluorescens | Asp-DOrn-Lys-c(Thr-Ala-Ala-DOrn-Lys) | 291 |
| CFBP2461 | P. putida | Asp-Lys-DAsp-Ser-DThr-DAla-Thr-DLys-cOrn | 292 |
| NCPPB2192 | P. tolaasii | DSer-Lys-Ser-DSer-Thr-DSer-Orn-Thr-DSer-cDOrn | 293 |
| PyC-E | P. aeruginosa | DSer-Arg-DSer-Orn-c(Lys-Orn-Thr-Thr) | 294 |
| PyR | P. aeruginosa | DSer-Dab-Orn-DGln-Gln-DOrn-Gly | 295 |
| PyPaTII | P. aeruginosa | DSer-DOrn-Orn-Gly-DThr-Ser-cOrn | 296 |
| Py Pap | P. aptata | DAla-Lys-Thr-DSer-Orm-cOrn | 297 |
| Py Pau | P. aureofaciens | DSer-DOrn-Gly-DThr-Thr-Gln-Gly-DSer-cDOrn | 298 |
| Ps | P. fluorescens | Lys-DAsp-Ala-DThr-Ala-cDOrn | 299 |
| Py I-III | P. fluorescens | Asn-DOrn-Lys-c(Thr-DAla-DAla-DOrn-Lys) | 300 |
| Py Gm | P. fluorescens | DAla-Lys-Gly-Gly-Asp-DGln-DSer-Ala-DAla-DAla-Ala-cOrn | 301 |
| Py Pf 12 | P. fluorescens | DSer-Lys-Gly-Orn-DSer-Ser-Gly-c(Lys-DOrn-Glu-Ser) | 302 |
| Py Pf 2798 | P. fluorescens | c(DSer-Dab)-Gly-Ser-Asp-Ala-Gly-DAla-Gly-cOrn | 303 |
| Py Pf 13525 | P. fluorescens | Ser-Lys-Gly-Orn-c(Lys-DOrn-Ser) | 304 |
| Py Pf 17400 | P. fluorescens | DAla-DLys-Gly-Gly-Asp-DGln-Dab-Ser-DAla-cOrn | 305 |
| Py 51W | P. fluorescens | DAla-DLys-Gly-Gly-DAsp-DGln-DSer-Ala-Gly-DThr-cOrn | 306 |

TABLE 3-continued

Illustrative list of novel targeting peptides.

| ID | Target(s) | Targeting Peptide Sequence | SEQ ID NO |
|---|---|---|---|
| Py 9AW | P. fluorescens | DSer-Lys-His-DThr-Ser-cOrn | 307 |
| Ps A225 | P. fluorescens | DSer-DAla-DOrn-Gly-c(DSer-DAsp-DSer-DThr) | 308 |
| Py Pf 1.3 | P. fluorescens | DAla-DLys-Gly-Gly-Asp-c(DGln-Dab)-Gly-Ser-cOrn | 309 |
| Py Pf 18.1 | P. fluorescens | DSer-Lys-Gly-Orn-Ser-DSer-Gly-c(Lys-DOrn-Ser) | 310 |
| Py Pf PL7 | P. fluorescens | DSer-DOrn-Ala-Gly-DThr-Ala-cOrn | 311 |
| Py Pf PL8 | P. fluorescens | DLys-DOrn-Ala-Gly-DThr-Ser-cOrn | 312 |
| Py Pf BTP7 | P. fluorescens | DSer-DSer-Orn-DSer-DSer-c(DSer-Orn-Lys-Lys) | 313 |
| Ps 589A | P. putida | Asp-Lys-Asp-DSer-Thr-DAla-DGlu-DSer-cOrn | 314 |
| Py Pp 1,2 | P. putida | Ser-Thr-DSer-Orn-Asp-DGln-Dab-Ser-DThr-cOrn | 315 |
| Py Pp C2,3 | P. putida | Asp-DOrn-DDab-Thr-Gly-DSer-Ser-Asp-Thr | 316 |
| Py G4R | P. putida | Asp-Orn-DAsp-Dab-Gly-Ser-cOrn | 317 |
| Py PpBTP16 | P. putida | Asp-DOrn-DDab-Thr-Gly-DSer-DSer-Thr-Asp | 318 |
| Py Pp39167 | P. putida | DSer-DAla-DOrn-Gly-DAla-DAsp-c(DSer-DThr) | 319 |
| iPy Pp BTP1 | P. putida | Asp-Ala-Asp-DOrn-Ser-cOrn | 320 |
| Py PT2192 | P. tolaasii | DSer-Lys-Ser-DSer-Thr-DSer-Orn-Thr-DSer-Orn | 321 |
| Ps 7SR1 | Pseudomonas spp. | DSer-DAsp-DThr-c(DSer-D-Orn-Ala-Gly-DSer) | 322 |
| Ps A214 | Pseudomonas spp. | DSer-DAla-Gly-DSer-DAla-DAsp-DThr-DOrn | 323 |
| Azoverdin | Pseudomonas spp. A. macrocytogenes | Hse-DHse-Dab-DOrn-DSer-Orn | 324 |
| PF-S024 | Corynebacteria spp. | SKRGRKRKDRRKKKANHGKRPNS | 325 |
| PF-001 | S. epidermidis M. luteus P. mirabilis E. coli P. aeruginosa C. albicans MRSA E. faecalis C. jeikeium | MNNWIIVAQLSVTVINEIIDIMKEKQKGGK | 326 |
| PF-002 | S. epidermidis P. mirabilis C. albicans C. jeikeium C. jejuni | NDDAQ | 327 |
| PF-003 | S. epidermidis M. luteus P. mirabilis C. albicans | MNNWIKVAQISVTVINEVIDIMKEKQNGGK | 328 |

TABLE 3-continued

Illustrative list of novel targeting peptides.

| ID | Target(s) | Targeting Peptide Sequence | SEQ ID NO |
|---|---|---|---|
| | MRSA<br>C. jeikeium | | |
| PF-004 | S. epidermidis<br>B. subtilis<br>B. fragilis<br>E. coli<br>P. aeruginosa<br>C. albicans<br>S. pneumoniae<br>E. faecalis<br>C. jeikeium | ARLSKAIIIAVIVVYHLDVRGLF | 329 |
| PF-005 | S. epidermidis<br>E. coli<br>MRSA<br>S. pneumoniae<br>E. faecalis | MESIFKIKLMNGICRSENMNMKKKNKGEKI | 330 |
| PF-006 | S. epidermidis<br>M. luteus<br>E. coli<br>P. aeruginosa<br>MRSA<br>E. faecalis<br>C. jeikeium<br>C. jejuni | MGIIAGIIKFIKGLIEKFTGK | 331 |
| PF-007 | S. epidermidis<br>M. luteus<br>E. coli<br>P. aeruginosa<br>C. albicans<br>MRSA<br>S. pneumoniae<br>E. faecalis<br>C. jeikeium | MGIIAGIIKVIKSLIEQFTGK | 332 |
| PF-008 | S. epidermidis<br>M. luteus<br>MRSA<br>C. jejuni | MIEIGSIAYLNGGSKKYNHILNQENR | 333 |
| PF-009 | M. luteus<br>P. mirabilis<br>C. albicans | SKKYNHILNQENR | 334 |
| PF-010 | S. epidermidis<br>M. luteus<br>E. coli<br>C. albicans | MDIDVNKLLQAFVYFKSFEKLRHNNS | 335 |
| PF-011 | M. luteus<br>E. coli<br>P. aeruginosa<br>S. pneumoniae<br>C. jeikeium | MFCYYKQHKGDNFSIEEVKNIIADNEMKVN | 336 |
| PF-012 | S. epidermidis<br>M. luteus<br>P. mirabilis<br>E. coli<br>P. aeruginosa<br>MRSA<br>S. pneumoniae<br>C. jeikeium<br>C. jejuni | WRGPNTEAGGKSANNIVQVGGAPT | 337 |
| PF-013 | M. luteus<br>P. mirabilis<br>E. coli<br>P. aeruginosa<br>MRSA<br>S. pneumoniae | LIQKGLNQTFIVVIRLNNFIKKS | 338 |

TABLE 3-continued

Illustrative list of novel targeting peptides.

| ID | Target(s) | Targeting Peptide Sequence | SEQ ID NO |
|---|---|---|---|
| | C. jeikeium<br>C. jejuni | | |
| PF-014 | E. coli<br>C. jeikeium | HPTDNKHN | 339 |
| PF-015 | E. faecalis<br>C. jeikeium | SIDKRNLYNLKYYE | 340 |
| PF-016 | S. epidermidis<br>E. faecalis<br>C. jeikeium | RKQYDDLSFNFLY | 341 |
| PF-017 | E. coli | ESIIE | 342 |
| PF-018 | E. coli<br>C. jeikeium | YYKTYFKEV | 343 |
| PF-020 | S. epidermidis<br>M. luteus<br>C. albicans<br>MRSA<br>S. pneumoniae<br>E. faecalis | MKIILLLFLIFGFIVVVTLKSEHQLTLFSI | 344 |
| PF-021 | S. epidermidis<br>M. luteus<br>P. mirabilis<br>E. coli<br>C. albicans<br>E. faecalis<br>C. jeikeium | FSLNFSKQKYVTVN | 345 |
| PF-022 | M. luteus<br>P. mirabilis<br>E. coli<br>P. aeruginosa<br>C. albicans<br>MRSA<br>S. pneumoniae<br>E. faecalis<br>C. jeikeium<br>C. jejuni | MINELKNKNSGIMNNYVVTKESKL | 346 |
| PF-023 | M. luteus<br>C. jeikeium | MTKNTIISLENEKTQINDSENESSDLRKAK | 347 |
| PF-024 | M. luteus<br>C. albicans<br>MRSA<br>E. faecalis<br>C. jeikeium | DLRKAK | 348 |
| PF-025 | S. epidermidis<br>M. luteus<br>P. mirabilis<br>E. coli<br>P. aeruginosa<br>MRSA<br>E. faecalis<br>C. jejuni | LLIIFRLWLELKWKNKK | 349 |
| PF-026 | S. epidermidis<br>M. luteus<br>P. mirabilis<br>C. albicans<br>MRSA<br>E. faecalis<br>C. jeikeium | SIHFIN | 350 |
| PF-027 | M. luteus<br>MRSA<br>E. faecalis<br>C. jejuni | HNARKYLEFISQKIDGDKLTKEDSL | 351 |

TABLE 3-continued

Illustrative list of novel targeting peptides.

| ID | Target(s) | Targeting Peptide Sequence | SEQ ID NO |
|---|---|---|---|
| PF-028 | S. epidermidis<br>M. luteus<br>MRSA | ALDCSEQSVILWYETILDKIVGVIK | 352 |
| PF-029 | S. epidermidis<br>M. luteus<br>C. albicans<br>C. jejuni | NSTNE | 353 |
| PF-030 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | MTCHQAPTTTHQSNMA | 354 |
| PF-031 | M. luteus<br>C. albicans | MPHHSTTSSRIVVPAHQSNMASTPNLSITP | 355 |
| PF-033 | S. epidermidis<br>M. luteus<br>E. coli<br>P. aeruginosa<br>C. albicans<br>MRSA<br>S. pneumoniae | MFIFKTTSKSHFHNNVKSLECIKIPINKNR | 356 |
| PF-034 | M. luteus | EPKKKHFPKMESASSEP | 357 |
| PF-035 | S. epidermidis<br>M. luteus<br>E. coli<br>C. albicans<br>MRSA<br>C. jeikeium<br>C. jejuni | SFYESY | 358 |
| PF-036 | S. epidermidis<br>M. luteus<br>P. mirabilis<br>E. coli<br>C. albicans<br>MRSA<br>S. pneumoniae<br>C. jejuni | ILNRLSRIVSNEVTSLIYSLK | 359 |
| PF-037 | S. epidermidis<br>M. luteus<br>P. aeruginosa<br>C. albicans<br>MRSA<br>S. pneumoniae<br>E. faecalis<br>C. jeikeium | MTKKRRYDTTEFGLAHSMTAKITLHQALYK | 360 |
| PF-038 | M. luteus | MAYKDEGKETKFAVKGYKD | 361 |
| PF-039 | P. mirabilis<br>C. jeikeium | MLEEKNKSL | 362 |
| PF-040 | S. epidermidis<br>M. luteus<br>P. mirabilis<br>E. coli<br>P. aeruginosa<br>C. albicans<br>MRSA<br>S. pneumoniae<br>E. faecalis | MIHLTKQNTMEALHFIKQFYDMFFILNFNV | 363 |

TABLE 3-continued

Illustrative list of novel targeting peptides.

| ID | Target(s) | Targeting Peptide Sequence | SEQ ID NO |
|---|---|---|---|
| | C. jeikeium<br>C. jejuni | | |
| PF-041 | MRSA | ELLVILPGFI | 364 |
| PF-042 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium | LLLSYFRYTGALLQSLF | 365 |
| PF-043 | M. luteus<br>C. jejuni | MIKNETAYQMNELLVIRSAYAK | 366 |
| PF-044 | S. epidermidis<br>M. luteus<br>MRSA<br>C. jeikeium | KLKKYIHKPD | 367 |
| PF-045 | S. epidermidis<br>E. coli<br>E. faecalis<br>C. jejuni | LDINDYRSTY | 368 |
| PF-046 | E. coli<br>E. faecalis<br>C. jeikeium | LDFYLTKHLTLML | 369 |
| PF-047 | S. mutans | NQEPSLQQDKEQKDNKG | 370 |
| PF-048 | S. epidermidis<br>M. luteus<br>E. coli<br>MRSA<br>C. jeikeium<br>C. jejuni | LYFAFKKYQERVNQAPNIEY | 371 |
| PF-049 | S. epidermidis<br>MRSA<br>C. jeikeium<br>C. jejuni | AYYLKRREEKGK | 372 |
| PF-050 | S. epidermidis<br>M. luteus<br>E. coli<br>C. jeikeium | SYYLKRREEKGK | 373 |
| PF-051 | S. epidermidis<br>M. luteus<br>P. aeruginosa<br>C. albicans<br>MRSA<br>S. pneumoniae<br>E. faecalis | RFFNFEIKKSTKVDYVFAHVDLSDV | 374 |
| PF-052 | S. epidermidis<br>M. luteus<br>E. coli<br>MRSA<br>E. faecalis<br>C. jeikeium<br>C. jejuni | QELINEAVNLLVKSK | 375 |
| PF-053 | S. epidermidis<br>M. luteus<br>E. coli<br>P. aeruginosa<br>C. albicans | KLFGQWGPELGSIYILPALIGSIILIAIVTL<br>ILRAMRK | 376 |

TABLE 3-continued

Illustrative list of novel targeting peptides.

| ID | Target(s) | Targeting Peptide Sequence | SEQ ID NO |
|---|---|---|---|
| | MRSA<br>S. pneumoniae<br>E. faecalis | | |
| PF-054 | S. epidermidis<br>E. coli | VSISRFIGGGHVFNGNNKRNL | 377 |
| PF-055 | S. mutans | GHVFNGNNKRNL | 378 |
| PF-056 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium | AEQLFGKQKQRGVDLFLNRLTIILSILFF<br>VLMICISYLGM | 379 |
| PF-057 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | TMIVISIPRFEEYMKARHKKWM | 380 |
| PF-058 | S. epidermidis<br>M. luteus<br>E. coli<br>C. albicans<br>MRSA<br>C. jeikeium<br>C. jejuni | FADQSQDNA | 381 |
| PF-060 | E. coli<br>C. albicans<br>C. jeikeium | HSSHL | 382 |
| PF-061 | S. epidermidis<br>S. pneumoniae | GYNSYKAVQDVKTHSEEQRVTAKK | 383 |
| PF-062 | S. epidermidis<br>M. luteus<br>E. coli<br>P. aeruginosa<br>MRSA<br>S. pneumoniae<br>E. faecalis<br>C. jeikeium | MKKKRINNDILGRMIYSSSIDKRNLYNL<br>KYYE | 384 |
| PF-063 | S. epidermidis<br>M. luteus<br>E. coli<br>P. aeruginosa<br>MRSA<br>S. pneumoniae<br>E. faecalis<br>C. jeikeium<br>C. jejuni | IAAIIVLVLFQKGLLQIFNWILIQLQ | 385 |
| PF-064 | E. coli | DYYGKE | 386 |
| PF-065 | M. luteus<br>E. coli<br>P. aeruginosa<br>C. albicans | LEKNTRDNYFIHAIDRIYINTSKGLFPES<br>ELVAWG | 387 |

TABLE 3-continued

Illustrative list of novel targeting peptides.

| ID | Target(s) | Targeting Peptide Sequence | SEQ ID NO |
|---|---|---|---|
| | MRSA<br>S. pneumoniae<br>C. jeikeium<br>C. jejuni | | |
| PF-066 | M. luteus<br>E. coli<br>C. jeikeium | IKGTVKAVDETTVVITVNGHGTELTFEK<br>PAIKQVDPS | 388 |
| PF-067 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | DLIVKVHICFVVKTASGYCYLNKREAQ<br>AAI | 389 |
| PF-068 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium | SHLINNFGLSVINPSTPICLNFSPVFNLLT<br>VYGITCN | 390 |
| PF-069 | E. faecalis<br>C. jejuni | FDPVPLKKDKSASKHSHKHNH | 391 |
| PF-070 | S. epidermidis<br>C. jejuni | SMVKSEIVDLLNGEDNDD | 392 |
| PF-071 | S. epidermidis<br>E. coli<br>P. aeruginosa<br>C. albicans<br>MRSA<br>S. pneumoniae<br>E. faecalis<br>C. jeikeium<br>C. jejuni | HCVIGNVVDIANLLKRRAVYRDIADVIK<br>MR | 393 |
| PF-073 | S. epidermidis<br>M. luteus<br>P. aeruginosa<br>C. albicans<br>MRSA<br>S. pneumoniae<br>E. faecalis | CPSVTMDACALLQKFDFCNNISHFRHFF<br>AIKQPIER | 394 |
| PF-074 | S. epidermidis<br>M. luteus<br>MRSA | RDIHPIYFMTKD | 395 |
| PF-075 | M. luteus<br>E. coli<br>P. aeruginosa<br>MRSA<br>C. jeikeium | FVNSLIMKDLSDNDMRFKYEYYNREKDT | 396 |
| PF-076 | S. epidermidis<br>M. luteus<br>E. coli<br>P. aeruginosa<br>C. albicans<br>MRSA<br>S. pneumoniae<br>E. faecalis | LYQYELLSKEEYLKCTLIINQRRNEQK | 397 |

TABLE 3-continued

Illustrative list of novel targeting peptides.

| ID | Target(s) | Targeting Peptide Sequence | SEQ ID NO |
|---|---|---|---|
| | C. jeikeium<br>C. jejuni | | |
| PF-097 | C. jeikeium | QPTQGEQGTRPRRPTPMRGLLI | 398 |
| PF-099 | S. epidermidis<br>M. luteus<br>E. coli<br>C. jeikeium | EIIAYLEGRFANA | 399 |
| PF-101 | S. mutans | DPVPERQEQACACHRTAKPGK | 400 |
| PF-104 | MRSA<br>C. jeikeium | ERTAVNDLWI | 401 |
| PF-123 | M. luteus<br>E. coli | TTRPQVAEDRQLDDALKETFPASDPISP | 402 |
| PF-124 | S. epidermidis<br>M. luteus<br>P. mirabilis<br>E. coli<br>P. aeruginosa<br>C. albicans<br>MRSA<br>E. faecalis<br>C. jejuni | MADGQIAAIAKLHGVPVATRNIRHFQSF<br>GVELINPWSG | 403 |
| PF-125 | S. epidermidis<br>M. luteus<br>P. mirabilis<br>E. coli<br>P. aeruginosa<br>C. albicans<br>MRSA<br>S. pneumoniae<br>E. faecalis<br>C. jejuni | YVVGALVILAVAGLIYSMLRKA | 404 |
| PF-126 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | FSPEAFGIGAAGVLGSFVTGLLIGWVAS<br>LLRKAK | 405 |
| PF-127 | S. epidermidis<br>M. luteus<br>E. coli<br>P. aeruginosa<br>C. albicans<br>MRSA<br>S. pneumoniae<br>E. faecalis | MLRYLSLFAVGLATGYAWGWIDGLAA<br>SLAV | 406 |
| PF-128 | M. luteus<br>P. aeruginosa<br>E. faecalis | GIKVVAARFEEIQFSENFDSIILA | 407 |
| PF-129 | S. epidermidis<br>MRSA<br>E. faecalis<br>C. jeikeium<br>C. jejuni | MKLLARDPWVCAWNDIW | 408 |
| PF-130 | E. faecalis<br>C. jeikeium<br>C. jejuni | LQRSDEESMPRRHEKYS | 409 |

TABLE 3-continued

Illustrative list of novel targeting peptides.

| ID | Target(s) | Targeting Peptide Sequence | SEQ ID NO |
|---|---|---|---|
| PF-131 | S. epidermidis<br>E. coli<br>MRSA<br>C. jeikeium | RRAAARTKGNRR | 410 |
| PF-132 | S. epidermidis<br>C. jeikeium | RPGDGAAEQGRSR | 411 |
| PF-133 | S. epidermidis<br>C. jeikeium<br>C. jejuni<br>M. smegmatis | GDPTAGQKPVECP | 412 |
| PF-134 | S. epidermidis<br>C. jeikeium | GKAMKRQDCSAL | 413 |
| PF-135 | S. epidermidis<br>M. luteus<br>E. coli<br>P. aeruginosa<br>MRSA<br>C. jeikeium<br>M. smegmatis | PPARPARIPQTPTLHGASLFRQRS | 414 |
| PF-136 | S. epidermidis<br>M. luteus<br>P. mirabilis<br>E. coli<br>MRSA<br>E. faecalis<br>C. jeikeium<br>C. jejuni<br>M. smegmatis | LRGRVGRITACGYPP | 415 |
| PF-137 | S. epidermidis<br>P. mirabilis<br>S. pneumoniae<br>C. jeikeium<br>C. jejuni | VLGKGHDLLDVGKTALKSRVFAWLGGS | 416 |
| PF-138 | S. epidermidis<br>M. luteus<br>P. mirabilis<br>E. coli<br>C. albicans<br>MRSA<br>C. jeikeium<br>C. jejuni | AVHHSLLFR | 417 |
| PF-139 | S. epidermidis<br>M. luteus<br>P. mirabilis<br>E. coli<br>P. aeruginosa<br>C. albicans<br>S. pneumoniae<br>E. faecalis<br>C. jeikeium<br>C. jejuni | ALSKPAIQARTLCRRQDPP | 418 |
| PF-140 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni<br>M. smegmatis | FHRRVIRASEWALTTRSFSTPLRSAAR | 419 |

TABLE 3-continued

Illustrative list of novel targeting peptides.

| ID | Target(s) | Targeting Peptide Sequence | SEQ ID NO |
|---|---|---|---|
| PF-141 | S. epidermidis<br>M. luteus<br>C. albicans<br>MRSA<br>C. jeikeium | VVRRFQGM | 420 |
| PF-142 | S. mutans | GIDRGCQAAR | 421 |
| PF-143 | S. epidermidis<br>MRSA<br>C. jeikeium | LSPRPIIVSRRSRADNNNDWSR | 422 |
| PF-144 | S. epidermidis<br>M. luteus<br>E. coli<br>C. albicans<br>MRSA<br>S. pneumoniae<br>E. faecalis<br>C. jeikeium | RSGQPVGRPSRRAWLR | 423 |
| PF-145 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni<br>M. smegmatis | GIVLTGRAGLVSGACSMALGVGLG | 424 |
| PF-146 | S. epidermidis<br>M. luteus<br>P. aeruginosa<br>C. albicans<br>MRSA<br>C. jeikeium | GCGKRRIITKSASRDTR | 425 |
| PF-147 | S. epidermidis<br>M. luteus<br>MRSA | RRPRRRRSGHGQSASAA | 426 |
| PF-148 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni<br>M. smegmatis | RRGCTERLRRMARRNAWDLYAEHFY | 427 |
| PF-149 | S. epidermidis<br>M. luteus<br>E. coli<br>MRSA<br>C. jeikeium | GKVSVLTRVPRSLGGAPANQ | 428 |
| PF-150 | S. epidermidis<br>MRSA | EIQAKGTG | 429 |
| PF-151 | S. epidermidis<br>MRSA<br>E. faecalis<br>C. jeikeium | EEYPARVPLSGEDVTEARRH | 430 |
| PF-152 | S. epidermidis<br>C. albicans | VGYFIWKDSHSRKG | 431 |

TABLE 3-continued

Illustrative list of novel targeting peptides.

| ID | Target(s) | Targeting Peptide Sequence | SEQ ID NO |
|---|---|---|---|
| | MRSA<br>E. faecalis<br>C. jeikeium | | |
| PF-153 | M. luteus<br>P. mirabilis<br>E. coli<br>MRSA | GILARADCSQIA | 432 |
| PF-154 | S. mutans | GIKKSKHPSTDDYVVKTTIDSL | 433 |
| PF-155 | C. jeikeium | GRYGDDSKERQGRAQ | 434 |
| PF-156 | S. epidermidis<br>C. jeikeium | LITAEQPATAPIAGK | 435 |
| PF-157 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | HTAVVWLAGVSGCVALSHCEPA | 436 |
| PF-158 | S. epidermidis | VRLESRPADLPE | 437 |
| PF-159 | S. epidermidis | TMAFVEKAQLRVPVGDDLPV | 438 |
| PF-160 | S. epidermidis | SFHASLTKNEKPIKSTG | 439 |
| PF-161 | S. epidermidis<br>M. luteus<br>E. coli<br>C. jejuni | RGRALASTATTRPARRRR | 440 |
| PF-162 | S. epidermidis<br>MRSA | GIRRLHSVENLNREISHRMAGLR | 441 |
| PF-163 | S. epidermidis | TSWLRAAERQEIGEPTKTFGEKTTSL | 442 |
| PF-164 | S. epidermidis<br>M. luteus<br>E. coli<br>C. jeikeium | EEVSRALAGIGLGLGCRIG | 443 |
| PF-165 | MRSA<br>C. jejuni | GPVSVVASLRRGTTVQRHSQNNHNKGKP | 444 |
| PF-166 | E. coli<br>C. jeikeium | SKAVSRKRSI | 445 |
| PF-167 | S. epidermidis<br>E. coli<br>C. albicans<br>MRSA<br>C. jeikeium<br>C. jejuni | AIEGVIKKGACFKLLRHEMF | 446 |
| PF-168 | S. epidermidis<br>M. luteus<br>E. coli<br>C. albicans<br>MRSA<br>C. jeikeium<br>C. jejuni | VLPFPAIPLSRRRACVAAPRPRSRQRAS | 447 |
| PF-169 | S. epidermidis<br>E. coli<br>C. albicans<br>E. faecalis<br>C. jeikeium | APGSAADSPRSRADD | 448 |

TABLE 3-continued

Illustrative list of novel targeting peptides.

| ID | Target(s) | Targeting Peptide Sequence | SEQ ID NO |
|---|---|---|---|
| PF-170 | S. epidermidis<br>M. luteus<br>P. mirabilis<br>E. coli<br>P. aeruginosa<br>C. albicans<br>MRSA<br>S. pneumoniae<br>E. faecalis<br>C. jejuni | RLARGRPTNLCGRRG | 449 |
| PF-171 | S. epidermidis<br>E. coli<br>P. aeruginosa<br>S. pneumoniae | TQVTLCRTW | 450 |
| PF-172 | S. epidermidis<br>M. luteus<br>E. coli<br>P. aeruginosa<br>MRSA<br>E. faecalis<br>C. jejuni | LTGVRRPWRAPWAGTSGWALR | 451 |
| PF-173 | S. epidermidis<br>M. luteus<br>P. mirabilis<br>E. coli<br>P. aeruginosa<br>C. albicans<br>C. jeikeium<br>C. jejuni | AGRTAIVQGGG | 452 |
| PF-174 | S. epidermidis<br>P. aeruginosa<br>C. jeikeium | RGGDSPARRRPGLAGPGGPG | 453 |
| PF-175 | S. epidermidis<br>E. faecalis | RRRPAGQRPEKASQAMIAA | 454 |
| PF-176 | S. epidermidis<br>M. luteus<br>P. mirabilis<br>E. coli<br>C. albicans<br>MRSA<br>E. faecalis<br>C. jeikeium | RLTSNQFLTRITPFVFAQH | 455 |
| PF-177 | M. luteus<br>MRSA<br>E. faecalis<br>C. jeikeium | VTSEPGIAHDIRLLPRAAAFR | 456 |
| PF-178 | S. epidermidis<br>M. luteus<br>B. subtilis<br>P. mirabilis<br>E. coli<br>P. aeruginosa<br>C. albicans<br>MRSA<br>S. pneumoniae<br>E. faecalis<br>C. jeikeium | EVYSSPTNNVAITVQNN | 457 |
| PF-180 | S. epidermidis<br>M. luteus<br>P. aeruginosa<br>C. albicans<br>MRSA<br>E. faecalis<br>C. jejuni<br>M. smegmatis | SGLGDLGFSSEAK | 458 |

TABLE 3-continued

Illustrative list of novel targeting peptides.

| ID | Target(s) | Targeting Peptide Sequence | SEQ ID NO |
|---|---|---|---|
| PF-181 | S. epidermidis<br>M. luteus<br>E. coli<br>MRSA<br>E. faecalis<br>C. jeikeium | GIAPRRNEWGAVGGR | 459 |
| PF-182 | S. epidermidis<br>M. luteus<br>E. coli<br>E. faecalis<br>C. jeikeium | LPATRDKTRVPASVAGAP | 460 |
| PF-183 | S. epidermidis<br>M. luteus<br>E. coli<br>C. albicans<br>MRSA<br>E. faecalis<br>C. jeikeium | KPGISVENRQ | 461 |
| PF-184 | S. epidermidis<br>M. luteus<br>E. coli<br>P. aeruginosa<br>C. albicans<br>MRSA<br>C. jeikeium | LIADRHIRA | 462 |
| PF-185 | E. coli<br>P. aeruginosa | RPAQARQGPGGLIADRHIRA | 463 |
| PF-186 | S. epidermidis<br>M. luteus<br>E. coli<br>P. aeruginosa<br>MRSA<br>C. jeikeium | DADKNLSLERDRFAWRVAAP | 464 |
| PF-187 | S. epidermidis<br>M. luteus<br>E. coli<br>MRSA | EIQKIAKGVSGQVYGPSRQITISKKR | 465 |
| PF-188 | S. epidermidis<br>M. luteus<br>E. coli<br>C. albicans<br>MRSA<br>E. faecalis | ARTFAGRLGTRYFGGLMRSTKA | 466 |
| PF-189 | S. epidermidis<br>M. luteus<br>C. albicans<br>MRSA<br>E. faecalis<br>C. jejuni | GNLTRSREAARATQ | 467 |
| PF-190 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium | HFILRKPLLFMIHSLKTGPLDRF | 468 |
| PF-191 | E. coli<br>P. aeruginosa<br>C. jejuni | QFCNFAWLFLASNNAQVSALA | 469 |
| PF-192 | S. epidermidis<br>M. luteus | VEEDEAPPPHY | 470 |

TABLE 3-continued

Illustrative list of novel targeting peptides.

| ID | Target(s) | Targeting Peptide Sequence | SEQ ID NO |
|---|---|---|---|
| | P. aeruginosa<br>C. albicans<br>E. faecalis<br>C. jeikeium | | |
| PF-193 | S. epidermidis<br>M. luteus<br>E. coli<br>MRSA<br>E. faecalis<br>C. jejuni | PPHCPPGHAKKGWC | 471 |
| PF-194 | C. jeikeium | MKGNKLATAHEQPVKNSAPPL | 472 |
| PF-195 | S. epidermidis<br>M. luteus<br>E. faecalis<br>C. jeikeium | EMAEGSADDRLRKTPRDC | 473 |
| PF-196 | S. epidermidis<br>M. luteus<br>P. mirabilis<br>E. coli<br>P. aeruginosa<br>C. albicans<br>MRSA<br>S. pneumoniae<br>E. faecalis<br>C. jejuni | TTARYIRRQCHTSITPLSQG | 474 |
| PF-197 | S. epidermidis<br>M. luteus<br>C. albicans<br>E. faecalis<br>C. jejuni | CNALLRRGHPPSAL | 475 |
| PF-200 | S. epidermidis<br>M. luteus<br>MRSA<br>E. faecalis<br>C. jeikeium | GIELKSLIMAQIERWRQA | 476 |
| PF-201 | S. epidermidis<br>M. luteus<br>E. coli<br>C. albicans<br>E. faecalis<br>C. jeikeium<br>C. jejuni | GCRPASLSDADPDGR | 477 |
| PF-202 | S. epidermidis<br>M. luteus<br>E. coli<br>MRSA<br>E. faecalis<br>C. jeikeium<br>C. jejuni | ALNRASLRLALGE | 478 |
| PF-203 | S. epidermidis<br>M. luteus<br>P. mirabilis<br>E. coli<br>P. aeruginosa<br>C. albicans<br>MRSA<br>S. pneumoniae<br>E. faecalis<br>C. jejuni | SWKCHHLAI | 479 |
| PF-204 | S. epidermidis<br>P. mirabilis<br>E. coli<br>P. aeruginosa<br>C. albicans<br>C. jejuni | ALQKQDMNLPSVKNQLVFLKSTG | 480 |

TABLE 3-continued

Illustrative list of novel targeting peptides.

| ID | Target(s) | Targeting Peptide Sequence | SEQ ID NO |
|---|---|---|---|
| PF-205 | S. epidermidis<br>M. luteus<br>E. coli<br>P. aeruginosa<br>C. albicans<br>MRSA<br>E. faecalis<br>C. jeikeium<br>C. jejuni | AGVLETPRCRGEYGAN | 481 |
| PF-206 | M. luteus<br>C. albicans<br>C. jeikeium<br>C. jejuni | KLRSASKKSLQEKSCGIMPEKPAG | 482 |
| PF-207 | M. luteus<br>C. jeikeium | AAGCRDLGSLSSLVTNPS | 483 |
| PF-208 | S. epidermidis<br>C. albicans<br>MRSA<br>S. pneumoniae<br>E. faecalis<br>C. jeikeium<br>C. jejuni | DAYHCHLVRSPDAHDLSMRIGFV | 484 |
| PF-209 | C. albicans<br>C. jeikeium<br>C. jejuni | NYAVVSHT | 485 |
| PF-210 | S. epidermidis<br>P. aeruginosa<br>C. albicans<br>MRSA<br>E. faecalis<br>C. jeikeium<br>C. jejuni | EREDGCDAMPLP | 486 |
| PF-211 | S. epidermidis<br>M. luteus<br>E. coli<br>P. aeruginosa<br>C. albicans<br>S. pneumoniae<br>E. faecalis<br>C. jeikeium<br>C. jejuni<br>M. smegmatis | DSFDSLSPFRERGGEREDGCDAMPLP | 487 |
| PF-212 | M. luteus<br>P. aeruginosa | NDSKASN | 488 |
| PF-213 | S. epidermidis | MTTGVDFIIEKV | 489 |
| PF-214 | S. mutans<br>S. epidermidis<br>M. luteus<br>E. coli<br>P. aeruginosa<br>A. baumannii | GHLRVCWVFSASLLTPFRSATLI | 490 |
| PF-215 | S. epidermidis<br>M. luteus<br>P. aeruginosa<br>A. baumannii | ELKITNYNVNTVLYRYYKWGNDLCE | 491 |
| PF-216 | S. mutans<br>E. coli | ESVDKITEALEEDGFPAKVQ | 492 |
| PF-217 | S. mutans | DWEFTHKTIPQKK | 493 |
| PF-218 | S. epidermidis<br>M. luteus | SETPEKPVGTFFYSIYYKIIL | 494 |

TABLE 3-continued

Illustrative list of novel targeting peptides.

| ID | Target(s) | Targeting Peptide Sequence | SEQ ID NO |
|---|---|---|---|
| | P. aeruginosa<br>A. baumannii | | |
| PF-219 | S. epidermidis<br>M. luteus<br>P. aeruginosa<br>A. baumannii | FLALAVIAGLFKVILIYAAPYLK | 495 |
| PF-221 | S. epidermidis<br>M. luteus<br>P. aeruginosa | VFDNIDINF | 496 |
| PF-222 | S. epidermidis | HIKETR | 497 |
| PF-223 | S. epidermidis<br>M. luteus<br>A. baumannii | VKFCIECQTKLERKRR | 498 |
| PF-224 | S. epidermidis<br>P. aeruginosa<br>A. baumannii | DYFYITLSQKNTF | 499 |
| PF-225 | S. epidermidis | MNCASPEFKKLMELYK | 500 |
| PF-226 | A. baumannii | LMFFSENMDKRDTLSGKFRYFAGSKVI<br>KLMNWLSENGK | 501 |
| PF-228 | S. mutans | NQLGSQAFAQL | 502 |
| PF-229 | S. epidermidis<br>M. luteus<br>P. aeruginosa<br>A. baumannii | DPILIQIGFTRFALRKAEAEKIEIQVEEGV<br>PA | 503 |
| PF-230 | S. mutans | EDKPTNTIQEIKPVKWQ | 504 |
| PF-231 | S. mutans | AVRDFKKSVREEDEAASLNSPRTIDAQ<br>VKTSESTSVKS | 505 |
| PF-232 | S. epidermidis<br>M. luteus | FDQLYALEREGKLDELLA | 506 |
| PF-233 | S. epidermidis<br>M. luteus<br>P. aeruginosa<br>A. baumannii | DANAMARTTIAIVYILALIALTISYSL | 507 |
| PF-234 | S. epidermidis<br>M. luteus | RTPYILRS | 508 |
| PF-235 | S. epidermidis<br>M. luteus | GIPFSKPHKRQVNYMKSDVLAYIEQNK<br>MAHTA | 509 |
| PF-236 | S. mutans<br>S. epidermidis<br>E. coli<br>C. albicans<br>S. pneumoniae<br>E. faecalis | KEIRTATVAELNAKRRLTSAEQALAEVS | 510 |
| PF-237 | S. epidermidis | YVKPKVGVHE | 511 |
| PF-238 | S. mutans<br>S. epidermidis<br>E. coli<br>P. aeruginosa<br>C. albicans<br>MRSA<br>S. pneumoniae<br>E. faecalis | RNAVVVTEATFPKYEEEITNYLNRRFGE<br>DWSLKLEKCSVA | 512 |
| PF-239 | S. mutans<br>E. coli | PKHNVVTGVSVDLDYKP | 513 |

TABLE 3-continued

Illustrative list of novel targeting peptides.

| ID | Target(s) | Targeting Peptide Sequence | SEQ ID NO |
|---|---|---|---|
| PF-240 | S. mutans<br>E. coli | RITEVPPDEHSDR | 514 |
| PF-242 | S. mutans<br>E. coli | KLFEDPLIKSKAVENFQTTWHEQCLAK<br>ELAKNM | 515 |
| PF-244 | S. epidermidis<br>M. luteus<br>P. aeruginosa<br>A. baumannii | HMRTISYLLAFAKFSLFIPPKQSLKRL | 516 |
| PF-245 | S. epidermidis<br>M. luteus<br>P. aeruginosa<br>A. baumannii | MNDVKPVVQPKQTLKAFLVQLLSVRA<br>GVYIKQNNQLPKTKG | 517 |
| PF-246 | S. mutans | QPDEKAEFFDPSLDKVYRHPTFYHIPDG<br>IEHM | 518 |
| PF-247 | S. epidermidis | ETAASETH | 519 |
| PF-248 | S. mutans<br>S. epidermidis<br>M. luteus<br>E. coli<br>P. aeruginosa<br>A. baumannii | ILSKLWFWMINSLGVVLLVSYWLLAK<br>WGVA | 520 |
| PF-249 | S. epidermidis<br>M. luteus | INSRYKISF | 521 |
| PF-252 | S. mutans | MKKLVAALAVIVILTGCVYDPVNYDKI<br>HDQEFQDHLRQNG | 522 |
| PF-253 | S. epidermidis<br>M. luteus | VRDDDS | 523 |
| PF-254 | S. epidermidis<br>M. luteus<br>P. aeruginosa<br>A. baumannii | FIYGVGFVPHFWLWKWLFSPWIAWPL<br>MLLGYYIWFLT | 524 |
| PF-255 | P. aeruginosa | DHKINESQHNPFRSDSNKQNVDFF | 525 |
| PF-256 | S. epidermidis | EYFKQVYVKNEKIYSFWICKDLSPKEA<br>AKRAEDILVKLK | 526 |
| PF-257 | S. epidermidis | VWENRKKYLENEIERHNVFLKLGQEVI<br>KGLNALASRGR | 527 |
| PF-259 | S. epidermidis<br>P. aeruginosa<br>A. baumannii | LPFSKIGRRVSYKKKDVLKYEQSKTVL<br>NTAQLATV | 528 |
| PF-262 | S. mutans<br>S. epidermidis<br>M. luteus<br>E. coli<br>P. aeruginosa<br>A. baumannii | DPHSEIDVTRYCQLHHFTCQTMQISERE<br>FHYLIETQ | 529 |
| PF-263 | S. epidermidis<br>M. luteus<br>A. baumannii | NLKKCPC | 530 |
| PF-265 | S. epidermidis<br>M. luteus<br>A. baumannii | MKTLFFPLFLIIFVLIIQALDQSYQKKIGI<br>SKPQKHPEFMQ | 531 |
| PF-266 | S. mutans | DQEKKNKTEESTEQ | 532 |
| PF-267 | M. luteus | SDDKRTD | 533 |
| PF-268 | S. mutans | EVLLSDLRPDIFSET | 534 |

TABLE 3-continued

Illustrative list of novel targeting peptides.

| ID | Target(s) | Targeting Peptide Sequence | SEQ ID NO |
|---|---|---|---|
| PF-270 | S. epidermidis<br>M. luteus<br>P. aeruginosa | MYLTPYAWIAVGSIFAFSVTTIKIGDQN<br>DEKQKSHKNDVHKR | 535 |
| PF-271 | S. epidermidis<br>M. luteus<br>P. aeruginosa<br>A. baumannii | AAQPQTTSP | 536 |
| PF-273 | S. epidermidis<br>M. luteus<br>P. aeruginosa<br>A. baumannii | LVGALLIFVALIYMVLKGNADKN | 537 |
| PF-275 | S. mutans | LVSGVANTVKNTAHTVGNTAKHAGHV<br>AADTTVKATKKQQVK | 538 |
| PF-276 | S. epidermidis | LDLALSTNSLNLEGFSF | 539 |
| PF-278 | M. luteus<br>A. baumannii | LSLATFAKIFMTRSNWSLKRFNRL | 540 |
| PF-279 | S. mutans<br>S. epidermidis<br>M. luteus<br>E. coli<br>P. aeruginosa<br>A. baumannii | SHIGFISISACLAVLLGIARLFVWTWVKF<br>FA | 541 |
| PF-281 | S. mutans<br>E. coli | SYNTYYNKLIHGQRTPDGM | 542 |
| PF-282 | S. mutans | QNNDTSAWCGSAHKNGNS | 543 |
| PF-283 | B. subtilis<br>B. fragilis<br>C. difficile | MIRIRSPTKKKLNRNSISDWKSNTSGRF<br>FY | 544 |
| PF-284 | C. difficile | MRYITYSLIPRLLSKKVIHQQ | 545 |
| PF-285 | S. mutans | VPAKLLRVIDEIPE | 546 |
| PF-288 | S. mutans<br>E. coli | IYQLLNIEYSEDD | 547 |
| PF-289 | C. difficile | MGRHLWNPSYFVATVSENTEEQIRKYR<br>KNK | 548 |
| PF-291 | S. mutans<br>E. coli | DVDGAIESEL | 549 |
| PF-292 | S. epidermidis<br>B. subtilis<br>B. fragilis | SFVSTTVRLIFEESKRYKF | 550 |
| PF-294 | S. epidermidis<br>C. difficile | DFLVNFLWFKGELNWGKKRYK | 551 |
| PF-295 | C. difficile | NIQVYESECGNYIFKKSDESFLIDIFDKN<br>GTH | 552 |
| PF-297 | S. epidermidis<br>B. subtilis<br>B. fragilis | ISKGIDDIVYVINKILSIGNIFKIIKRK | 553 |
| PF-299 | B. subtilis | LATKLKYEKEHKKM | 554 |
| PF-300 | B. subtilis<br>C. difficile | VKDVLLELFNKIIGA | 555 |
| PF-301 | C. difficile | GIVLIGLKLIPLLANVLN | 556 |
| PF-304 | S. mutans | LVKDTSDIKNDLNNIEIVTSKNSNDIAKL<br>KSVK | 557 |

TABLE 3-continued

Illustrative list of novel targeting peptides.

| ID | Target(s) | Targeting Peptide Sequence | SEQ ID NO |
|---|---|---|---|
| PF-305 | C. difficile | MREWICPSCNETHDRDINASINILKEGL RLITIQNK | 558 |
| PF-306 | C. difficile | GCILPHKKDNYNYIMSKFQDLVKITSKK | 559 |
| PF-307 | S. epidermidis<br>B. subtilis<br>B. fragilis<br>C. difficile | MKRRRCNWCGKLFYLEEKSKEAYCCK ECRKKAKKVKK | 560 |
| PF-308 | C. difficile | QQYLILDRM | 561 |
| PF-309 | S. mutans<br>E. coli | GIPGMTAAPAEENEQEENADEE | 562 |
| PF-311 | C. difficile | IDAVTKKKTTCMIRAPTKIPIAHTDN | 563 |
| PF-313 | S. epidermidis<br>C. difficile | YITSHKNARAIIKKFERDEILEEVITHYL NRK | 564 |
| PF-314 | S. mutans | ECLKKAIKSKALNKAFKIDVPDEVYDN LLMELEEYEK | 565 |
| PF-317 | S. mutans | LILVSDI | 566 |
| PF-319 | S. epidermidis<br>B. subtilis<br>C. difficile | SIGSMIGMYSFRHKTKHIKFTFGIPFILFL QFLLVYFYILK | 567 |
| PF-320 | S. mutans<br>E. coli | DSGYYALLENKEERVVWDGEVVANNI FNNLWIVVNKVKTG | 568 |
| PF-323 | S. mutans | ARESIEKSHVPVDATIVGVVDSFEVFDE | 569 |
| PF-324 | C. difficile | HFSLL | 570 |
| PF-325 | S. mutans<br>E. coli | LTIDEKLRNHR | 571 |
| PF-326 | S. mutans<br>E. coli | VIVGNLGAQKEKRNDTPISAKKDIMGD KTVRVRADLHH | 572 |
| PF-328 | S. mutans | NGNEKAFSEVENLVK | 573 |
| PF-329 | S. epidermidis | IGILFDKSVRKY | 574 |
| PF-333 | S. mutans | YMTKKLVEMAEQQMAGKSNR | 575 |
| PF-334 | S. epidermidis<br>C. difficile | QQYLILDRM | 576 |
| PF-336 | S. mutans<br>E. coli | MLTSRKKRLKKIVEEQNKKDESI | 577 |
| PF-337 | S. epidermidis | YMTKKLVEMAERQMAGK | 578 |
| PF-338 | S. mutans | KGTSCPDQLSKAIRQSI | 579 |
| PF-340 | S. mutans<br>E. coli | VKDVLLELFNKIIGA | 580 |
| PF-344 | B. subtilis<br>C. jejuni | DERLPEAKAIRNFNGSVMVLGR | 581 |
| PF-347 | S. epidermidis<br>B. subtilis<br>B. fragilis<br>E. coli<br>P. aeruginosa<br>C. albicans<br>MRSA<br>S. pneumoniae<br>E. faecalis | GIFTGVTVVVSLKHC | 582 |

TABLE 3-continued

Illustrative list of novel targeting peptides.

| ID | Target(s) | Targeting Peptide Sequence | SEQ ID NO |
|---|---|---|---|
| PF-348 | B. subtilis<br>E. coli<br>P. aeruginosa<br>C. albicans<br>E. faecalis<br>C. jejuni | ESASAAEWYNPNMNVKKAICMG | 583 |
| PF-349 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium | MPKSCHVPVLCDFFFLVIIKFLALFKTIQS | 584 |
| PF-350 | S. epidermidis<br>E. coli<br>E. faecalis<br>C. jeikeium<br>C. jejuni | LAVILRAIVY | 585 |
| PF-351 | S. mutans | YLFFKGKKVAEEEATKDEVKR | 586 |
| PF-352 | C. jeikeium | RVKKIG | 587 |
| PF-353 | S. epidermidis<br>M. luteus<br>B. subtilis<br>E. coli<br>C. albicans<br>S. pneumoniae<br>E. faecalis<br>C. jeikeium<br>C. jejuni | EKTNFKGVKRNFYKKASFFV | 588 |
| PF-354 | S. epidermidis<br>B. subtilis<br>E. coli<br>P. aeruginosa<br>C. albicans<br>MRSA<br>S. pneumoniae<br>E. faecalis<br>C. jeikeium<br>C. jejuni | FTFSKCRASNGRGFGTLWL | 589 |
| PF-355 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium | WIAIGLLLYFSLKNQ | 590 |
| PF-356 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium | VSIKIGAIVIGMIGLMELLTE | 591 |
| PF-357 | S. epidermidis<br>M. luteus<br>P. mirabilis<br>E. coli | MLTIIIGFIFWTMTLMLGYLIGEREGRKHE | 592 |

TABLE 3-continued

Illustrative list of novel targeting peptides.

| ID | Target(s) | Targeting Peptide Sequence | SEQ ID NO |
|---|---|---|---|
| | P. aeruginosa<br>C. albicans<br>MRSA<br>S. pneumoniae<br>E. faecalis<br>C. jeikeium | | |
| PF-358 | S. epidermidis<br>B. subtilis<br>E. coli<br>C. albicans<br>MRSA<br>S. pneumoniae<br>E. faecalis<br>C. jeikeium<br>C. jejuni | RNTAHNIKWRSKN | 593 |
| PF-359 | S. epidermidis<br>B. fragilis<br>P. aeruginosa<br>C. albicans<br>MRSA<br>E. faecalis<br>C. jeikeium | MTVMEDPGSEQRNKIQSPMKGEDFSAL<br>FGR | 594 |
| PF-360 | S. epidermidis<br>B. subtilis<br>E. coli<br>P. aeruginosa<br>C. albicans<br>E. faecalis<br>C. jeikeium<br>C. jejuni | MEQKVKVIFVPRSKPDNQLKTFVSAVL<br>FKA | 595 |
| PF-361 | S. epidermidis<br>E. coli<br>E. faecalis<br>C. jejuni | NQVTEGIRLLVE | 596 |
| PF-362 | S. epidermidis<br>E. coli<br>P. aeruginosa<br>C. albicans<br>E. faecalis<br>C. jejuni | NIERILKEKVWMIRCVE | 597 |
| PF-363 | B. subtilis<br>E. coli<br>P. aeruginosa<br>C. albicans<br>S. pneumoniae<br>E. faecalis | SMLSVTVMCLMHASVAANQAMEKKV | 598 |
| PF-364 | S. epidermidis<br>B. fragilis<br>P. aeruginosa<br>C. jeikeium<br>C. jejuni | LVNGIKI | 599 |
| PF-365 | S. epidermidis<br>B. subtilis<br>B. fragilis<br>P. aeruginosa<br>C. albicans | LYKQKIQLEEELEKLKDDRQ | 600 |
| PF-366 | S. epidermidis<br>M. luteus<br>B. fragilis<br>P. mirabilis<br>E. coli<br>P. aeruginosa<br>C. albicans<br>MRSA<br>S. pneumoniae<br>E. faecalis | ALCSVIKAIELGIINVHLQ | 601 |

TABLE 3-continued

Illustrative list of novel targeting peptides.

| ID | Target(s) | Targeting Peptide Sequence | SEQ ID NO |
|---|---|---|---|
| | C. jeikeium<br>C. jejuni | | |
| PF-367 | B. subtilis | TKTPGTFTPGTGIQKTAVPL | 602 |
| PF-368 | C. jeikeium<br>C. jejuni | MLKQTA | 603 |
| PF-369 | B. subtilis<br>B. fragilis<br>E. coli<br>P. aeruginosa<br>C. albicans<br>S. pneumoniae<br>C. jeikeium<br>C. jejuni | MSEAVNLLRGARYSQRYAKNQVPYEVI<br>IEK | 604 |
| PF-370 | S. epidermidis<br>E. coli<br>P. aeruginosa<br>E. faecalis<br>C. jejuni | VIFLHKESGNLKEIFY | 605 |
| PF-371 | S. epidermidis<br>B. fragilis<br>C. jejuni | TFIYNEF | 606 |
| PF-372 | C. jeikeium<br>C. jejuni | KKQDKRIEDKYKRMKKGD | 607 |
| PF-373 | S. epidermidis<br>E. coli<br>P. aeruginosa<br>C. albicans<br>MRSA<br>E. faecalis<br>C. jejuni | HFYLLFER | 608 |
| PF-374 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium<br>C. jejuni | HLFFVKGMFILCQKNQINDE | 609 |
| PF-375 | S. epidermidis<br>B. subtilis<br>B. fragilis<br>E. coli<br>P. aeruginosa<br>C. albicans<br>S. pneumoniae<br>E. faecalis<br>C. jeikeium<br>C. jejuni | MDSAKAQTMRTDWLAVSCLVASAYLR<br>SMLA | 610 |
| PF-376 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium<br>C. jejuni | MTVFEALMLAIAFATLIVKISNKNDKK | 611 |
| PF-378 | B. subtilis<br>B. fragilis | ESAKSNLNFLMQEEWALFLLL | 612 |

TABLE 3-continued

Illustrative list of novel targeting peptides.

| ID | Target(s) | Targeting Peptide Sequence | SEQ ID NO |
|---|---|---|---|
| | E. coli<br>P. aeruginosa<br>C. jeikeium | | |
| PF-379 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium<br>C. jejuni | VFVVLFIIYLASKLLTKLFPIKK | 613 |
| PF-380 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium<br>C. jejuni | KKIIPLITLFVVTLVG | 614 |
| PF-381 | E. coli<br>P. aeruginosa<br>C. jejuni | QGANPCQQVGFTVNDPDCRLAKTV | 615 |
| PF-382 | S. epidermidis<br>B. subtilis<br>B. fragilis<br>E. coli<br>P. aeruginosa<br>E. faecalis<br>C. jeikeium<br>C. jejuni | KYKCSWCKRVYTLRKDHKTAR | 616 |
| PF-383 | S. epidermidis<br>B. subtilis<br>B. fragilis<br>E. coli<br>C. jejuni | WSEIEINTKQSN | 617 |
| PF-384 | E. faecalis<br>C. jeikeium<br>C. jejuni | HISKERFEAY | 618 |
| PF-385 | S. epidermidis<br>E. coli<br>P. aeruginosa<br>C. albicans<br>E. faecalis | MIKKSILKIKYYVPVLISLTLILSA | 619 |
| PF-386 | S. epidermidis<br>B. subtilis<br>B. fragilis<br>E. coli<br>P. aeruginosa<br>C. albicans<br>S. pneumoniae<br>E. faecalis<br>C. jeikeium<br>C. jejuni | FTLTLITTIVAILNYKDKKK | 620 |
| PF-387 | B. subtilis<br>E. coli<br>P. aeruginosa<br>E. faecalis<br>C. jeikeium<br>C. jejuni | GAVGIAFFAGNMKQDKRIADRQNKKSEKK | 621 |

TABLE 3-continued

Illustrative list of novel targeting peptides.

| ID | Target(s) | Targeting Peptide Sequence | SEQ ID NO |
|---|---|---|---|
| PF-388 | E. faecalis<br>C. jeikeium<br>C. jejuni | ITPLLDEIGKVCIDKISK | 622 |
| PF-389 | S. epidermidis<br>C. albicans<br>MRSA<br>S. pneumoniae<br>E. faecalis<br>C. jeikeium | GLQFKEIAEEFHITTTALQQWHKDNGY<br>PIYNKNNRK | 623 |
| PF-390 | S. epidermidis<br>P. aeruginosa<br>C. albicans<br>MRSA | VVAYVITQVGAIRF | 624 |
| PF-392 | S. epidermidis<br>B. subtilis<br>S. pneumoniae<br>C. jeikeium<br>C. jejuni | DPAGCNDIVRKYCK | 625 |
| PF-393 | S. epidermidis<br>E. coli<br>C. albicans<br>MRSA<br>S. pneumoniae<br>C. jejuni | DLVQSILSEFKKSG | 626 |
| PF-394 | S. epidermidis<br>MRSA<br>C. jejuni | VLKEECYQKN | 627 |
| PF-395 | S. epidermidis<br>E. coli<br>P. aeruginosa<br>S. pneumoniae<br>E. faecalis<br>C. jeikeium<br>C. jejuni | YCVPLGNMGNMNNKIW | 628 |
| PF-396 | S. epidermidis<br>E. coli<br>P. aeruginosa<br>C. albicans<br>E. faecalis<br>C. jeikeium | LIYTILASLGVLTVLQAILGREPKAVKA | 629 |
| PF-397 | S. epidermidis<br>MRSA<br>S. pneumoniae<br>E. faecalis<br>C. jejuni | VEDLMEDLNA | 630 |
| PF-398 | S. epidermidis<br>B. subtilis<br>B. fragilis<br>E. coli<br>P. aeruginosa<br>C. albicans<br>MRSA<br>S. pneumoniae<br>E. faecalis<br>C. jeikeium<br>C. jejuni | ILVVLAGILLVVLSYVGISKFKMNC | 631 |
| PF-399 | S. epidermidis<br>M. luteus<br>P. mirabilis<br>E. coli<br>P. aeruginosa<br>C. albicans | FPIISALLGAIICIAIYSFIVNRKA | 632 |

TABLE 3-continued

Illustrative list of novel targeting peptides.

| ID | Target(s) | Targeting Peptide Sequence | SEQ ID NO |
|---|---|---|---|
| | MRSA<br>S. pneumoniae<br>E. faecalis<br>C. jejuni | | |
| PF-400 | S. epidermidis<br>E. coli<br>S. pneumoniae<br>E. faecalis<br>C. jeikeium | VIAWKFRNKFENSGV | 633 |
| PF-401 | S. epidermidis<br>E. coli<br>P. aeruginosa<br>MRSA<br>E. faecalis<br>C. jejuni | YWLSRVTTGHSFAFEKPVPLSLTIK | 634 |
| PF-402 | S. epidermidis<br>P. aeruginosa<br>E. faecalis<br>C. jejuni | FIDVLKSKINEFLN | 635 |
| PF-403 | E. coli<br>P. aeruginosa<br>S. pneumoniae<br>E. faecalis<br>C. jeikeium<br>C. jejuni | LLSTEQLLKYYDGETFDGFQLPSNE | 636 |
| PF-404 | S. epidermidis<br>E. coli<br>P. aeruginosa<br>E. faecalis<br>C. jeikeium<br>C. jejuni | VLYFQATVV | 637 |
| PF-405 | S. epidermidis<br>E. coli<br>E. faecalis | LVRIEVDDLEEWYERNFI | 638 |
| PF-406 | E. coli<br>C. jejuni | YLEMNADYLSNMDIFDELWEKYLENNK | 639 |
| PF-407 | S. epidermidis<br>B. subtilis<br>E. coli<br>P. aeruginosa<br>MRSA<br>S. pneumoniae<br>E. faecalis<br>C. jeikeium<br>C. jejuni | KPKNKKEKTVISYEKLLSMY | 640 |
| PF-408 | S. epidermidis<br>E. coli<br>P. aeruginosa<br>MRSA<br>E. faecalis<br>C. jeikeium<br>C. jejuni | YCVPLGNMGNMNNKIW | 641 |
| PF-409 | S. epidermidis<br>MRSA<br>C. jeikeium<br>C. jejuni | DLVQSILSEFKKSG | 642 |
| PF-410 | S. epidermidis<br>M. luteus<br>B. fragilis<br>P. mirabilis<br>E. coli<br>P. aeruginosa<br>C. albicans | FALELIALCRNLFIVYFP | 643 |

TABLE 3-continued

Illustrative list of novel targeting peptides.

| ID | Target(s) | Targeting Peptide Sequence | SEQ ID NO |
|---|---|---|---|
| | MRSA<br>S. pneumoniae<br>E. faecalis | | |
| PF-411 | M. luteus<br>B. subtilis<br>B. fragilis<br>P. mirabilis<br>P. aeruginosa<br>C. albicans<br>MRSA<br>S. pneumoniae<br>E. faecalis<br>C. jeikeium<br>C. jejuni | WVAVAILLNIALQTQLT | 644 |
| PF-412 | M. luteus<br>E. coli<br>C. albicans<br>C. jeikeium<br>C. jejuni | TSGWLGQLEQ | 645 |
| PF-413 | P. aeruginosa<br>C. albicans<br>C. jejuni | TFAGSIKIGVPDLVHVTFNCKR | 646 |
| PF-414 | E. coli<br>C. albicans<br>C. jeikeium | LLNKKLE | 647 |
| PF-416 | S. pneumoniae<br>C. jeikeium | SKAGLYGKIERSDKRE | 648 |
| PF-417 | S. epidermidis<br>C. jeikeium<br>C. jejuni | DSYFRS | 649 |
| PF-418 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | FFLVHFYIRKRKGKVSIFLNYF | 650 |
| PF-421 | C. jeikeium | KHCFEITDKTDVV | 651 |
| PF-422 | C. albicans<br>MRSA<br>C. jeikeium | MSRKKYENDEKSQKKLKIGRKSDVFYG<br>IID | 652 |
| PF-423 | S. epidermidis<br>M. luteus<br>E. coli<br>S. pneumoniae<br>E. faecalis<br>C. jeikeium | AGKKERLLSFREQFLNKNKKK | 653 |
| PF-424 | S. epidermidis<br>C. albicans<br>MRSA | IAAFVTSRAFSDTVSPI | 654 |
| PF-425 | S. epidermidis<br>M. luteus<br>E. coli<br>P. aeruginosa<br>C. albicans<br>MRSA<br>S. pneumoniae<br>C. jeikeium | MMELVLKTIIGPIVVGVVLRIVDKWLN<br>KDK | 655 |

TABLE 3-continued

Illustrative list of novel targeting peptides.

| ID | Target(s) | Targeting Peptide Sequence | SEQ ID NO |
|---|---|---|---|
| PF-426 | S. epidermidis<br>E. coli<br>P. aeruginosa<br>C. albicans<br>MRSA<br>S. pneumoniae<br>E. faecalis<br>C. jeikeium | MLQKYTQMISVTKCIITKNKKTQENVDAYN | 656 |
| PF-427 | M. luteus<br>P. aeruginosa<br>C. albicans<br>C. jejuni | YVLEYHGLRATQDVDAFMAL | 657 |
| PF-428 | S. epidermidis<br>C. albicans<br>E. faecalis<br>C. jeikeium | ENEESIF | 658 |
| PF-429 | S. epidermidis<br>S. pneumoniae<br>C. jeikeium | AATLICVGSGIMSSL | 659 |
| PF-430 | S. epidermidis<br>M. luteus<br>E. coli<br>S. pneumoniae<br>E. faecalis<br>C. jeikeium<br>C. jejuni | AVVCGYLAYTATS | 660 |
| PF-431 | S. epidermidis<br>M. luteus<br>E. coli<br>P. aeruginosa<br>MRSA<br>S. pneumoniae<br>E. faecalis<br>C. jeikeium<br>C. jejuni | VAYAAICWW | 661 |
| PF-432 | S. epidermidis<br>M. luteus<br>E. coli<br>P. aeruginosa<br>C. albicans<br>MRSA<br>S. pneumoniae<br>E. faecalis<br>C. jeikeium<br>C. jejuni | FNGDSEFFLCIAF | 662 |
| PF-433 | S. epidermidis<br>E. coli<br>S. pneumoniae<br>C. jeikeium | MRKEFHNVLSSGQLLADKRPARDYNRK | 663 |
| PF-434 | S. epidermidis<br>M. luteus<br>S. pneumoniae<br>C. jeikeium | GQLLADKRPARDYNRK | 664 |
| PF-435 | C. jeikeium | MSRWDGHSDKGEAPAGKPPMHGFGLNGENK | 665 |
| PF-436 | C. jeikeium | KKHVLVGKQEKNG | 666 |
| PF-438 | S. epidermidis<br>E. coli<br>S. pneumoniae<br>C. jeikeium<br>C. jejuni | QPYFQNQFKKITGYTPLQYRKEKR | 667 |
| PF-439 | S. epidermidis<br>M. luteus | RVLVLKKFHGIMDGNRNVAVFFVGQ | 668 |

TABLE 3-continued

Illustrative list of novel targeting peptides.

| ID | Target(s) | Targeting Peptide Sequence | SEQ ID NO |
|---|---|---|---|
| | B. fragilis<br>P. mirabilis<br>E. coli<br>P. aeruginosa<br>C. albicans<br>MRSA<br>S. pneumoniae<br>E. faecalis<br>C. jeikeium<br>C. jejuni | | |
| PF-440 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | MFIISPDLFNIAVILYILFFIHDILLLILS | 669 |
| PF-441 | C. jeikeium | TQVHKMARGIDPGPANGIYR | 670 |
| PF-442 | S. epidermidis<br>E. coli<br>C. albicans<br>S. pneumoniae<br>E. faecalis | MQIFYIKTKIFLSFFLFLLIFSQCFYKIEE | 671 |
| PF-443 | S. epidermidis<br>M. luteus<br>P. mirabilis<br>E. coli<br>P. aeruginosa<br>C. albicans<br>S. pneumoniae<br>E. faecalis<br>C. jeikeium<br>C. jejuni | KLLYFFNYFENLQQVHLLVQL | 672 |
| PF-444 | M. luteus<br>C. albicans<br>S. pneumoniae<br>C. jeikeium | MAAKLWEEGKMVYASSASMTKRLKL<br>AMSKV | 673 |
| PF-445 | M. luteus<br>S. pneumoniae<br>C. jeikeium | ASMTKRLKLAMSKV | 674 |
| PF-446 | M. luteus<br>C. jeikeium | SGNEKV | 675 |
| PF-447 | S. epidermidis<br>M. luteus<br>E. coli<br>S. pneumoniae | IDKSRNKDQFSHIFGLYNICSG | 676 |
| PF-448 | S. epidermidis<br>M. luteus<br>P. mirabilis<br>E. coli<br>S. pneumoniae<br>E. faecalis<br>C. jeikeium<br>C. jejuni | SLQSQLGPCLHDQRH | 677 |
| PF-450 | S. epidermidis<br>M. luteus<br>E. coli<br>P. aeruginosa<br>C. albicans<br>MRSA<br>S. pneumoniae | HRNLIILQRTIFI | 678 |

TABLE 3-continued

Illustrative list of novel targeting peptides.

| ID | Target(s) | Targeting Peptide Sequence | SEQ ID NO |
|---|---|---|---|
| | E. faecalis<br>C. jeikeium<br>C. jejuni | | |
| PF-451 | S. epidermidis<br>M. luteus<br>E. coli<br>P. aeruginosa<br>C. albicans<br>MRSA<br>S. pneumoniae<br>E. faecalis<br>C. jeikeium<br>C. jejuni<br>M. smegmatis | MVNYIIGSYMLYREQNNEALRKFDIT<br>LAM | 679 |
| PF-452 | M. luteus<br>P. aeruginosa<br>C. albicans<br>S. pneumoniae<br>E. faecalis<br>C. jeikeium<br>M. smegmatis | MNNWIKVAQISVTVINEVIDIMKEKQN<br>GGK | 680 |
| PF-453 | M. luteus<br>E. coli<br>P. aeruginosa<br>S. pneumoniae<br>E. faecalis<br>C. jeikeium<br>C. jejuni | IIQDIAHAFGY | 681 |
| PF-454 | S. epidermidis<br>M. luteus<br>E. coli<br>P. aeruginosa<br>C. albicans<br>MRSA<br>S. pneumoniae<br>E. faecalis<br>C. jeikeium<br>C. jejuni<br>M. smegmatis | MSVFVPVTNIFMFIMSPIFNVNLLHFKV<br>YI | 682 |
| PF-456 | C. albicans<br>MRSA<br>E. faecalis<br>C. jeikeium<br>C. jejuni | TCVKPRTIN | 683 |
| PF-457 | C. albicans<br>S. pneumoniae<br>E. faecalis<br>C. jeikeium | INKYHHIA | 684 |
| PF-458 | S. epidermidis<br>M. luteus<br>E. coli<br>P. aeruginosa<br>C. albicans<br>MRSA<br>S. pneumoniae<br>E. faecalis<br>C. jeikeium<br>C. jejuni | ISLIIFIMLFVVALFKCITNYKHQS | 685 |
| PF-459 | P. aeruginosa | EKRMSFNENQSHRPLL | 686 |
| PF-460 | S. epidermidis<br>M. luteus<br>P. mirabilis<br>E. coli<br>P. aeruginosa<br>C. albicans | MEHVLPFQNTPPNIVIIYKDFTHLKSITFS | 687 |

TABLE 3-continued

Illustrative list of novel targeting peptides.

| ID | Target(s) | Targeting Peptide Sequence | SEQ ID NO |
|---|---|---|---|
| | MRSA<br>S. pneumoniae<br>E. faecalis<br>C. jeikeium<br>C. jejuni<br>M. smegmatis | | |
| PF-461 | E. coli<br>S. pneumoniae | MTLAIKNCSVTKCLGFGDFVNDDSDSY<br>FDA | 688 |
| PF-462 | E. faecalis<br>C. jeikeium | KNKTDTL | 689 |
| PF-463 | S. epidermidis<br>E. coli<br>P. aeruginosa<br>C. albicans<br>S. pneumoniae<br>E. faecalis<br>M. smegmatis | MVILVFSLIFIFTDNYLVYQSKSIKEDVMI | 690 |
| PF-464 | S. epidermidis<br>C. albicans<br>MRSA<br>S. pneumoniae<br>E. faecalis<br>C. jeikeium<br>C. jejuni | VDMVNRFLGN | 691 |
| PF-465 | S. epidermidis<br>M. luteus<br>E. coli<br>P. aeruginosa<br>C. albicans<br>MRSA<br>S. pneumoniae<br>E. faecalis<br>C. jeikeium<br>C. jejuni | KPVGKALEEIADGKIEPVVPKEYLG | 692 |
| PF-466 | MRSA<br>C. jeikeium<br>C. jejuni | VRKSDQ | 693 |
| PF-467 | MRSA<br>E. faecalis<br>C. jeikeium<br>C. jejuni | YYKDYFKEI | 694 |
| PF-469 | S. epidermidis<br>M. luteus<br>P. mirabilis<br>E. coli<br>C. albicans<br>MRSA<br>S. pneumoniae<br>E. faecalis<br>C. jeikeium<br>C. jejuni | YKVNYNNIDNHFNTLRH | 695 |
| PF-470 | M. luteus<br>E. coli<br>MRSA<br>E. faecalis<br>C. jeikeium<br>C. jejuni | PYSDSYATRPHWEQHRAR | 696 |
| PF-471 | S. epidermidis<br>M. luteus<br>E. coli<br>P. aeruginosa<br>C. albicans<br>MRSA<br>S. pneumoniae<br>E. faecalis | MVGKIRGVTPRNDLLNANITGQLNLNY<br>RLI | 697 |

TABLE 3-continued

Illustrative list of novel targeting peptides.

| ID | Target(s) | Targeting Peptide Sequence | SEQ ID NO |
|---|---|---|---|
| | C. jeikeium<br>C. jejuni | | |
| PF-472 | S. epidermidis<br>E. coli<br>P. aeruginosa<br>C. albicans<br>MRSA<br>S. pneumoniae<br>E. faecalis<br>C. jeikeium | MHISHLLDEVEQTEREKAVNVLENMNG<br>NVI | 698 |
| PF-473 | S. epidermidis<br>E. coli<br>P. aeruginosa<br>C. albicans<br>MRSA<br>S. pneumoniae<br>E. faecalis | MAADIISTIGDLVKWIIDTVNKFKK | 699 |
| PF-474 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni<br>M. smegmatis | MHRNLVLVKMEPIPHIMIIANQIGIIIEKA | 700 |
| PF-475 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | MREKVRFTQAFKLFWTNYFNFKGRSRR<br>SEY | 701 |
| PF-476 | M. luteus<br>P. mirabilis<br>C. albicans<br>S. pneumoniae<br>E. faecalis<br>C. jeikeium<br>C. jejuni | WADAQYKLCENCSE | 702 |
| PF-477 | S. epidermidis<br>M. luteus<br>C. albicans<br>S. pneumoniae<br>C. jeikeium<br>C. jejuni | HKNKLNIPHIKS | 703 |
| PF-478 | S. epidermidis<br>M. luteus<br>P. mirabilis<br>E. coli<br>C. albicans<br>S. pneumoniae<br>E. faecalis<br>C. jeikeium<br>C. jejuni | HLFILKSHLKPFPPFRYTYD | 704 |
| PF-479 | S. epidermidis<br>M. luteus<br>P. mirabilis<br>E. coli<br>C. albicans | AYILKRREEKNK | 705 |

TABLE 3-continued

Illustrative list of novel targeting peptides.

| ID | Target(s) | Targeting Peptide Sequence | SEQ ID NO |
|---|---|---|---|
|  | S. pneumoniae<br>E. faecalis<br>C. jeikeium<br>C. jejuni |  |  |
| PF-480 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni<br>M. smegmatis | MVEILVNTAISVYIVALYTQWLSTRDNL<br>KA | 706 |
| PF-481 | C. jeikeium | DELYEIMDKVIEEFNKDIEQNNNNGNN<br>EDLTENKIN | 707 |
| PF-482 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | LVGYVRTSGTVRSYKIN | 708 |
| PF-483 | P. mirabilis<br>C. jeikeium<br>C. jejuni | EDNKDKKDKKDK | 709 |
| PF-484 | S. epidermidis<br>M. luteus<br>P. mirabilis<br>E. coli<br>E. faecalis<br>C. jeikeium<br>C. jejuni | HKKDIRKQVFKN | 710 |
| PF-486 | S. mutans | MQKEGEEDY | 711 |
| PF-487 | S. mutans<br>E. coli | MYKAIAVLAMTIMAFFIFVYPFFIVGLILG | 712 |
| PF-488 | S. mutans<br>E. coli | YPNEQGHHKNNLKNIIIE | 713 |
| PF-489 | S. mutans | KVDRVSTTITEKIK | 714 |
| PF-490 | S. mutans | RLILVSGNATVQK | 715 |
| PF-491 | S. mutans<br>E. coli | IHQYSSKPDIVGQEAKTVQQINS | 716 |
| PF-492 | S. mutans<br>B. subtilis<br>E. coli | IQIDAASFYSISKSTIK | 717 |
| PF-493 | S. mutans<br>B. subtilis<br>E. coli | PGAFFFCRGRGCWCGIGW | 718 |
| PF-494 | S. mutans | FTEPLRPLQAKGQIISIKPSTSSS | 719 |
| PF-495 | S. mutans<br>E. coli | KGIYKKRTY | 720 |

TABLE 3-continued

Illustrative list of novel targeting peptides.

| ID | Target(s) | Targeting Peptide Sequence | SEQ ID NO |
|---|---|---|---|
| PF-496 | S. mutans<br>E. coli | EVTKRLVALAQQQLRG | 721 |
| PF-497 | S. mutans<br>B. subtilis<br>E. coli | LVLRICTDLFTFIKWTIKQRKS | 722 |
| PF-498 | S. mutans<br>E. coli | MSEEEEVSEKVYNYLRRNEFFEVRKEEFSA | 723 |
| PF-499 | S. mutans<br>E. coli | VYSFLYVLVIVRKLLSMKKRIERL | 724 |
| PF-500 | S. mutans<br>E. coli | MGIFKEEKIKFIDCKGEEVILKIKIKDIKK | 725 |
| PF-501 | S. mutans | GSTAHKSPIGSTNNQWGMKKTPTD | 726 |
| PF-502 | S. mutans | NKGKQMQDQTGKQPIVDNG | 727 |
| PF-503 | S. mutans | VVTLKDIVAVIEDQGYDVQ | 728 |
| PF-504 | S. mutans<br>E. coli | ILSVELSTKTSASGS | 729 |
| PF-505 | S. mutans | GYTKDPGTGI | 730 |
| PF-506 | S. mutans<br>E. coli | SGRGFALIVVLFILLIIVGAACIR | 731 |
| PF-507 | S. mutans<br>E. coli | LALSIANLFKKKA | 732 |
| PF-508 | S. mutans | VSTFGKVVKVVDEK | 733 |
| PF-509 | S. mutans<br>B. subtilis<br>E. coli | EAKVQAKGEQIACNNY | 734 |
| PF-510 | S. mutans<br>E. coli | WYLYKKQSNQNDRGIPK | 735 |
| PF-511 | E. coli<br>P. aeruginosa<br>S. pneumoniae<br>C. jeikeium | VMQSLYVKPPLILVTKLAQQN | 736 |
| PF-512 | S. pneumoniae<br>C. jeikeium | SFMPEIQKNTIPTQMK | 737 |
| PF-513 | C. albicans | SNGVGLGVGIGSGIRF-NH2 | 738 |
| PF-514 | S. epidermidis<br>E. coli<br>P. aeruginosa<br>C. albicans<br>MRSA<br>S. pneumoniae<br>E. faecalis<br>C. jeikeium | QRFYKLFYHIDLTNEQALKLFQVK | 739 |
| PF-515 | S. epidermidis<br>C. albicans<br>S. pneumoniae<br>C. jeikeium | DKSTQDKDIKQAKLLAQELGL-NH2 | 740 |
| PF-517 | C. jejuni | VKPTMTASLISTVC | 741 |
| PF-518 | S. epidermidis<br>E. coli<br>P. aeruginosa<br>C. albicans | SFYSKYSRYIDNLAGAIFLFF | 742 |

TABLE 3-continued

Illustrative list of novel targeting peptides.

| ID | Target(s) | Targeting Peptide Sequence | SEQ ID NO |
|---|---|---|---|
| | MRSA<br>S. pneumoniae<br>E. faecalis | | |
| PF-519 | M. luteus<br>E. faecalis<br>C. jeikeium | YLVYSGVLATAAAF-NH2 | 743 |
| PF-520 | S. epidermidis<br>M. luteus<br>E. coli<br>C. albicans<br>MRSA<br>S. pneumoniae<br>E. faecalis<br>C. jeikeium<br>C. jejuni | LGLTAGVAYAAQPTNQPTNQPTN<br>QPTNQPTNQPRW-NH2 | 744 |
| PF-521 | S. epidermidis<br>E. coli<br>P. aeruginosa<br>S. pneumoniae<br>E. faecalis | CGKLLEQKNFFLKTR | 745 |
| PF-522 | S. epidermidis<br>E. coli<br>P. aeruginosa<br>S. pneumoniae<br>E. faecalis | FELVDWLETNLGKILKSKSA-NH2 | 746 |
| PF-523 | S. epidermidis<br>M. luteus<br>C. albicans<br>S. pneumoniae<br>C. jeikeium<br>C. jejuni | ASKQASKQASKQASKQASRSLKN<br>HLL | 747 |
| PF-524 | S. epidermidis<br>E. coli<br>P. aeruginosa<br>C. albicans<br>MRSA<br>S. pneumoniae<br>E. faecalis<br>C. jeikeium | PDAPRTCYHKPILAALSRIVVTDR | 748 |
| PF-526 | S. epidermidis<br>E. coli<br>P. aeruginosa<br>C. albicans<br>MRSA<br>S. pneumoniae<br>E. faecalis<br>C. jeikeium<br>C. jejuni | VLLLFIFQPFQKQLL-NH2 | 749 |
| PF-527 | S. epidermidis<br>M. luteus<br>P. mirabilis<br>E. coli<br>P. aeruginosa<br>MRSA<br>S. pneumoniae<br>E. faecalis<br>C. jeikeium<br>C. jejuni | GSVIKKRRKRMAKKKHRKLLKKTRIQR<br>RRAGK | 750 |
| PF-528 | S. epidermidis<br>P. aeruginosa<br>C. albicans<br>MRSA<br>S. pneumoniae<br>E. faecalis | LVDVVVLIRRHLPKSCS-NH2 | 751 |

TABLE 3-continued

Illustrative list of novel targeting peptides.

| ID | Target(s) | Targeting Peptide Sequence | SEQ ID NO |
|---|---|---|---|
| PF-529 | S. epidermidis<br>E. coli<br>C. albicans<br>MRSA<br>S. pneumoniae<br>E. faecalis<br>C. jeikeium | LSEMERRRLRKRA-NH2 | 752 |
| PF-537 | S. epidermidis<br>M. luteus<br>P. mirabilis<br>E. coli<br>C. albicans<br>MRSA<br>S. pneumoniae<br>E. faecalis<br>C. jeikeium | LANDYYKKTKKSW | 753 |
| PF-539 | S. epidermidis<br>M. luteus<br>B. subtilis<br>P. mirabilis<br>E. coli<br>P. aeruginosa<br>C. albicans<br>MRSA<br>S. pneumoniae<br>E. faecalis<br>C. jeikeium | SIILTKKKRRKIPLSIDSQIYKYTFKQ | 754 |
| PF-540 | C. albicans | KSILILIKVIFIGQTTIIL | 755 |
| PF-542 | C. jeikeium | KKDNPSLNDQDKNAVLNLLALAK | 756 |
| PF-543 | S. epidermidis<br>M. luteus<br>B. subtilis<br>P. mirabilis<br>E. coli<br>P. aeruginosa<br>C. albicans<br>MRSA<br>S. pneumoniae<br>E. faecalis<br>C. jeikeium | NILFGIIGFVVAMTAAVIVTAISIAK | 757 |
| PF-544 | S. epidermidis<br>M. luteus<br>P. mirabilis<br>P. aeruginosa<br>MRSA<br>S. pneumoniae<br>E. faecalis<br>C. jeikeium<br>C. jejuni | FGEKQMRSWWKVHWFHP | 758 |
| PF-545 | S. epidermidis<br>E. coli<br>P. aeruginosa<br>S. pneumoniae<br>E. faecalis<br>C. jeikeium | RESKLIAMADMIRRRI-NH2 | 759 |
| PF-546 | S. epidermidis<br>E. coli<br>C. albicans<br>S. pneumoniae<br>E. faecalis<br>C. jeikeium | PIIAPTIKTQIQ | 760 |
| PF-547 | S. epidermidis<br>E. coli<br>P. aeruginosa<br>C. albicans | WSRVPGHSDTGWKVWHRW-NH2 | 761 |

TABLE 3-continued

Illustrative list of novel targeting peptides.

| ID | Target(s) | Targeting Peptide Sequence | SEQ ID NO |
|---|---|---|---|
| | MRSA<br>S. pneumoniae<br>E. faecalis | | |
| PF-548 | M. luteus<br>P. mirabilis<br>E. coli<br>P. aeruginosa<br>C. albicans<br>S. pneumoniae<br>E. faecalis<br>C. jeikeium<br>C. jejuni | ARPIADLIHFNSTTVTASGDVYYGPG | 762 |
| PF-549 | E. coli<br>C. albicans<br>S. pneumoniae<br>C. jeikeium | TGIGPIARPIEHGLDS | 763 |
| PF-550 | S. pneumoniae | STENGWQEFESYADVGVDPRRYVPL | 764 |
| PF-551 | S. pneumoniae | QVKEKRREIELQFRDAEKKLEASVQAE | 765 |
| PF-552 | S. pneumoniae | ELDKADAALGPAKNLAPLDVINRS | 766 |
| PF-553 | S. epidermidis<br>E. coli<br>P. aeruginosa<br>C. albicans<br>MRSA<br>S. pneumoniae<br>C. jeikeium | LTIVGNALQQKNQKLLLNQKKITSLG | 767 |
| PF-554 | S. pneumoniae | AKNFLTRTAEEIGEQAVREGNINGP | 768 |
| PF-555 | MRSA<br>S. pneumoniae<br>C. jeikeium | EAYMRFLDREMEGLTAAYNVKLFTEAIS | 769 |
| PF-556 | S. epidermidis<br>M. luteus<br>B. fragilis<br>P. mirabilis<br>E. coli<br>P. aeruginosa<br>C. albicans<br>MRSA<br>S. pneumoniae<br>E. faecalis | SLQIRMNTLTAAKASIEAA | 770 |
| PF-557 | S. pneumoniae | AANKAREQAAAEAKRKAEEQAR | 771 |
| PF-558 | S. epidermidis<br>E. coli<br>C. albicans<br>C. jeikeium<br>C. jejuni | ADAPPPLIVRYS | 772 |
| PF-559 | S. epidermidis<br>M. luteus<br>C. albicans<br>C. jeikeium<br>C. jejuni | SRPGKPGGVSIDVSRDRQDILSNYP | 773 |
| PF-560 | S. epidermidis<br>M. luteus<br>E. coli<br>S. pneumoniae<br>C. jeikeium<br>C. jejuni | FGNPFRGFTLAMEADFKKRK | 774 |
| PF-562 | S. epidermidis<br>M. luteus<br>P. mirabilis<br>E. coli | TPEQWLERSTVVVTGLLNRK | 775 |

TABLE 3-continued

Illustrative list of novel targeting peptides.

| ID | Target(s) | Targeting Peptide Sequence | SEQ ID NO |
|---|---|---|---|
| | P. aeruginosa<br>C. albicans<br>MRSA<br>S. pneumoniae<br>E. faecalis<br>C. jeikeium<br>C. jejuni | | |
| PF-563 | S. epidermidis<br>M. luteus<br>C. jeikeium | RPELDNELDVVQNSASLDKLQASYN | 776 |
| PF-564 | S. epidermidis<br>C. albicans<br>S. pneumoniae<br>C. jeikeium | TIILNDQINSLQERLNKLNAETDRR | 777 |
| PF-566 | P. mirabilis<br>S. pneumoniae | EAQQVTQQLGADFNAITTPTATKV | 778 |
| PF-567 | S. epidermidis<br>P. aeruginosa<br>C. albicans<br>MRSA<br>S. pneumoniae<br>C. jeikeium | QQRVKAVDASLSQVSTQVSGAVASA | 779 |
| PF-568 | S. epidermidis | TQAVQVKTAQAQQQ | 780 |
| PF-569 | M. luteus<br>P. mirabilis<br>S. pneumoniae<br>E. faecalis<br>C. jeikeium | KSKISEYTEKEFLEFVEDIYTNNK | 781 |
| PF-570 | S. pneumoniae<br>C. jeikeium | KKFPTEESHIQAVLEFKKLTEHPSG | 782 |
| PF-572 | S. epidermidis<br>M. luteus<br>E. coli<br>S. pneumoniae<br>C. jeikeium | WRASKGLPGFKAG | 783 |
| PF-573 | S. epidermidis<br>S. pneumoniae | EKKLIVKLIDSIGKSHEEIVGAG | 784 |
| PF-575 | M. luteus<br>E. coli<br>C. albicans<br>MRSA<br>S. pneumoniae<br>E. faecalis<br>C. jeikeium | LNFRAENKILEKIHISLIDTVEGSA | 785 |
| PF-576 | M. luteus<br>P. mirabilis<br>E. coli<br>P. aeruginosa<br>C. albicans<br>S. pneumoniae | AYSGELPEPLVRKMSKEQVRSVMGK | 786 |
| PF-577 | S. epidermidis<br>M. luteus<br>P. mirabilis<br>E. coli<br>P. aeruginosa<br>C. albicans<br>MRSA<br>S. pneumoniae<br>E. faecalis | PFETRESFRVPVIGILGGWDYFMHP | 787 |
| PF-578 | S. epidermidis<br>M. luteus<br>P. mirabilis | QKANLRIGFTYTSDSNVCNLTFALLGSK | 788 |

TABLE 3-continued

Illustrative list of novel targeting peptides.

| ID | Target(s) | Targeting Peptide Sequence | SEQ ID NO |
|---|---|---|---|
| | P. aeruginosa<br>C. albicans<br>MRSA<br>S. pneumoniae<br>E. faecalis<br>C. jeikeium | | |
| PF-579 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | MILVCAAVIWGRVLFILKFPIYFSIRLAFL | 789 |
| PF-580 | S. epidermidis<br>M. luteus<br>E. coli<br>P. aeruginosa<br>C. albicans<br>MRSA<br>S. pneumoniae<br>E. faecalis<br>C. jeikeium | EILNNNQVIKELTMKYKTQFESNLGGW<br>TARARR | 790 |
| PF-581 | S. epidermidis<br>M. luteus<br>E. coli<br>P. aeruginosa<br>C. albicans<br>MRSA<br>S. pneumoniae<br>E. faecalis<br>C. jeikeium | WTARARR | 791 |
| PF-583 | S. epidermidis<br>M. luteus<br>E. coli<br>P. aeruginosa<br>C. albicans<br>MRSA<br>S. pneumoniae<br>E. faecalis<br>C. jeikeium | KFQGEFTNIGQSYIVSASHMSTSLNTGK | 792 |
| PF-584 | S. epidermidis<br>M. luteus<br>P. mirabilis<br>C. albicans<br>MRSA<br>S. pneumoniae<br>E. faecalis<br>C. jeikeium | SYIKNLSNQKFLIAF | 793 |
| PF-585 | S. epidermidis<br>E. coli<br>C. albicans<br>MRSA<br>S. pneumoniae<br>C. jeikeium | DYNHLLNVVQDWVNTN | 794 |
| PF-586 | S. epidermidis<br>M. luteus<br>E. coli<br>P. aeruginosa<br>MRSA<br>S. pneumoniae<br>E. faecalis<br>C. jeikeium<br>C. jejuni | FFNQANYFFKEF | 795 |

TABLE 3-continued

Illustrative list of novel targeting peptides.

| ID | Target(s) | Targeting Peptide Sequence | SEQ ID NO |
|---|---|---|---|
| PF-587 | S. epidermidis<br>M. luteus<br>E. coli<br>MRSA<br>S. pneumoniae<br>E. faecalis<br>C. jeikeium | ASGKYQSYLLNVYVDSKKDRLDIFDKL<br>KAKAKFVL | 796 |
| PF-588 | S. epidermidis<br>E. coli<br>C. albicans<br>E. faecalis<br>C. jeikeium<br>C. jejuni | ESVEAIKAKAIK | 797 |
| PF-589 | S. epidermidis<br>C. albicans<br>MRSA<br>S. pneumoniae | APLRIDEIRNSNVIDEVLDCAPKKQEHFF<br>VVPKIIE | 798 |
| PF-590 | S. epidermidis<br>M. luteus<br>E. coli<br>E. faecalis<br>C. jeikeium | YYQAKLFPLL | 799 |
| PF-592 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | IMKNYKYFKLFIVKYALF | 800 |
| PF-593 | C. jeikeium | MEISTLKKEKLHVKDELSQYLANYKK | 801 |
| PF-594 | C. jeikeium | IVSAIV | 802 |
| PF-595 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | LQNKIYELLYIKERSKLCS | 803 |
| PF-596 | S. epidermidis<br>M. luteus<br>P. mirabilis<br>E. coli<br>P. aeruginosa<br>MRSA<br>E. faecalis<br>C. jeikeium<br>C. jejuni | SKMWDKILTILILILELIRELIKL | 804 |
| PF-597 | P. mirabilis | DEIKVSDEEIEKFIKENNL | 805 |
| PF-598 | S. epidermidis<br>M. luteus<br>P. mirabilis<br>P. aeruginosa<br>C. albicans<br>MRSA<br>S. pneumoniae<br>C. jeikeium | MKFMLEVRNKAISAYKEITRTQI | 806 |

TABLE 3-continued

Illustrative list of novel targeting peptides.

| ID | Target(s) | Targeting Peptide Sequence | SEQ ID NO |
|---|---|---|---|
| PF-599 | S. epidermidis<br>P. mirabilis<br>E. coli<br>C. albicans<br>MRSA<br>S. pneumoniae<br>C. jeikeium | LFEIFKPKH | 807 |
| PF-600 | S. epidermidis<br>M. luteus<br>B. subtilis<br>P. mirabilis<br>E. coli<br>P. aeruginosa<br>MRSA<br>S. pneumoniae<br>E. faecalis<br>C. jeikeium | TKKIELKRFVDAFVKKSYENYILERELK<br>KLIKAINEELPTK | 808 |
| PF-601 | C. jeikeium | YRVTVKALE | 809 |
| PF-602 | P. mirabilis<br>C. jeikeium | LEKEKKEYIEKLFKTK | 810 |
| PF-603 | S. epidermidis<br>M. luteus<br>B. subtilis<br>E. coli<br>P. aeruginosa<br>MRSA<br>S. pneumoniae<br>E. faecalis<br>C. jeikeium | IDKLKKMNLQKLSYEVRISQDGKSIYAR<br>IK | 811 |
| PF-604 | S. epidermidis<br>C. albicans<br>C. jeikeium | LMEQVEV | 812 |
| PF-605 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | HYRWNTQWWKY | 813 |
| PF-607 | S. epidermidis<br>P. mirabilis<br>E. coli<br>MRSA<br>S. pneumoniae<br>C. jeikeium | YIESDPRKFDYIFGAIRDH | 814 |
| PF-609 | P. mirabilis<br>E. coli<br>S. pneumoniae | TEIKLDNNEYLVLNLDDILGILK | 815 |
| PF-610 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium<br>C. jejuni | VFLKLKTSKIDLASIIFYP | 816 |
| PF-612 | S. epidermidis<br>M. luteus | GTTLKYGLERQLKIDIHPEITIINLNGGA<br>DEFAKL | 817 |

TABLE 3-continued

Illustrative list of novel targeting peptides.

| ID | Target(s) | Targeting Peptide Sequence | SEQ ID NO |
|---|---|---|---|
| | P. mirabilis<br>E. coli<br>P. aeruginosa<br>C. albicans<br>MRSA<br>S. pneumoniae<br>E. faecalis<br>C. jeikeium | | |
| PF-613 | C. jeikeium | ADEFAKL | 818 |
| PF-614 | S. epidermidis<br>E. coli<br>C. jeikeium | GLDIYA | 819 |
| PF-615 | S. epidermidis<br>M. luteus<br>P. mirabilis<br>E. coli<br>P. aeruginosa<br>C. albicans<br>MRSA<br>S. pneumoniae<br>C. jeikeium<br>C. jejuni | FLNRFIFYIFTVKTKSALIKNLFLD | 820 |
| PF-616 | C. jeikeium | IVFVVTKEKK | 821 |
| PF-617 | P. aeruginosa<br>C. albicans | PMNAAEPE | 822 |
| PF-619 | S. epidermidis<br>M. luteus<br>B. subtilis<br>P. mirabilis<br>E. coli<br>P. aeruginosa<br>C. albicans<br>MRSA<br>S. pneumoniae<br>E. faecalis<br>C. jeikeium | WSRVPGHSDTGWKVWHRW | 823 |
| PF-621 | S. epidermidis<br>C. albicans | PPSSFLV | 824 |
| PF-622 | S. epidermidis<br>P. aeruginosa<br>C. albicans<br>S. pneumoniae<br>E. faecalis<br>C. jeikeium | TREDVFSVRLINNIVNKQA | 825 |
| PF-623 | S. epidermidis<br>P. aeruginosa<br>MRSA<br>S. pneumoniae<br>E. faecalis<br>C. jeikeium | VLFAVYLGALDWLFSWLTQKM | 826 |
| PF-625 | S. epidermidis<br>M. luteus<br>S. pneumoniae<br>C. jeikeium | SDSTNNARTRKKARDVTTKDIDK | 827 |
| PF-626 | S. epidermidis<br>M. luteus<br>E. coli<br>C. albicans<br>MRSA<br>S. pneumoniae<br>E. faecalis<br>C. jeikeium | KYDFDDFEPEEA | 828 |

TABLE 3-continued

Illustrative list of novel targeting peptides.

| ID | Target(s) | Targeting Peptide Sequence | SEQ ID NO |
|---|---|---|---|
| PF-627 | S. epidermidis<br>P. aeruginosa<br>MRSA<br>S. pneumoniae<br>E. faecalis<br>C. jeikeium | INDLLSYFTLHEK | 829 |
| PF-629 | S. epidermidis<br>P. aeruginosa<br>C. albicans<br>MRSA<br>S. pneumoniae<br>E. faecalis<br>C. jeikeium | GLAAIATVFALY | 830 |
| PF-630 | S. epidermidis<br>M. luteus<br>P. mirabilis<br>P. aeruginosa<br>C. albicans<br>MRSA<br>S. pneumoniae<br>E. faecalis<br>C. jeikeium | IPATPIIHS | 831 |
| PF-631 | S. epidermidis<br>P. aeruginosa<br>C. albicans<br>MRSA<br>S. pneumoniae<br>E. faecalis<br>C. jeikeium | LIIYFSKTGNTARATRQI | 832 |
| PF-632 | S. epidermidis<br>P. aeruginosa<br>C. albicans<br>MRSA<br>S. pneumoniae<br>E. faecalis<br>C. jeikeium | TTIQGVASLEKHGFRYTIIYPTRI | 833 |
| PF-634 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium | MPKARPVNHNKKKSKITIKSNFTLFYM<br>FNP | 834 |
| PF-635 | S. epidermidis<br>P. aeruginosa<br>C. albicans<br>MRSA<br>S. pneumoniae<br>E. faecalis<br>C. jeikeium | MNAHGHSLIFQKMIVHAFAFFSKQKNY<br>LYF | 835 |
| PF-636 | S. epidermidis<br>C. albicans<br>MRSA<br>S. pneumoniae<br>E. faecalis | LVRLA | 836 |
| PF-637 | S. epidermidis<br>P. aeruginosa<br>C. albicans<br>MRSA<br>S. pneumoniae<br>E. faecalis<br>C. jeikeium | SRIKQDARSVRKYDRIGIFFYSFKSA | 837 |

TABLE 3-continued

Illustrative list of novel targeting peptides.

| ID | Target(s) | Targeting Peptide Sequence | SEQ ID NO |
|---|---|---|---|
| PF-638 | S. epidermidis<br>C. albicans<br>MRSA<br>C. jeikeium | TFILPK | 838 |
| PF-639 | S. pneumoniae<br>C. jeikeium | QATQIKSWIDRLLVSED | 839 |
| PF-640 | C. albicans | MGDINRNF | 840 |
| PF-641 | S. epidermidis<br>M. luteus<br>E. coli<br>C. albicans<br>MRSA<br>E. faecalis<br>C. jeikeium<br>C. jejuni | SWKCHHLAIGGSWKCHHLAI | 841 |
| PF-642 | M. luteus<br>MRSA<br>C. jeikeium | FTTPMIGIPAGLLGGSYYLKRREEKGK | 842 |
| PF-643 | Mycobacteria spp | VRCRL | 843 |
| PF-644 | Mycobacteria spp | TSGLIIGENGLNGL | 844 |
| PF-645 | Mycobacteria spp | SNSVQQG | 845 |
| PF-646 | Mycobacteria spp | APASPGRRPG | 846 |
| PF-647 | Mycobacteria spp | GTFLGQKCAAATAS | 847 |
| PF-648 | S. mutans<br>E. coli | ARRYPAAGS | 848 |
| PF-649 | Mycobacteria spp | CPRYPFVDVGPAGPWRARWRVGS | 849 |
| PF-650 | Mycobacteria spp | IRSDQPGRQSRSSPRWPTGAGRHR | 850 |
| PF-651 | Mycobacteria spp | PRWPTGAGRHR | 851 |
| PF-652 | Mycobacteria spp | FLAPARPDLQAQRQALAQ | 852 |
| PF-653 | Mycobacteria spp | QSVHPLPAETPVADVI | 853 |
| PF-654 | Mycobacteria spp | LSGRLAGRR | 854 |
| PF-655 | M. smegmatis | DAPCFDDQFGDLKCQMC | 855 |
| PF-656 | Mycobacteria spp | RGMFVPFHDVDCVQ | 856 |
| PF-657 | Mycobacteria spp | YVANYTITQFGRDFDDRLAVAIHFA | 857 |
| PF-658 | Mycobacteria spp | PTTPPPTTPPEIPTGGTVIST | 858 |
| PF-659 | Mycobacteria spp | TVIST | 859 |
| PF-660 | Mycobacteria spp | TDPQATAAPRRRTSPR | 860 |
| PF-661 | Mycobacteria spp | PDEDIRRRAILPPAGPCRPMSPE | 861 |
| PF-662 | Mycobacteria spp | GKQSRAHGPVASRREFRRKSG | 862 |
| PF-663 | Mycobacteria spp | ATLIPRKA | 863 |
| PF-664 | M. smegmatis | DQLCVEYPARVSTG | 864 |
| PF-665 | Mycobacteria spp | VLRVATAVGEVPTGL | 865 |
| PF-666 | Mycobacteria spp | PNRRSRPR | 866 |
| PF-667 | Mycobacteria spp | PAHQRLRIDQRLVADRDMVQDYES | 867 |
| PF-668 | Mycobacteria spp | TNAESMALAFRGRVHMSVNIAGLT | 868 |

TABLE 3-continued

Illustrative list of novel targeting peptides.

| ID | Target(s) | Targeting Peptide Sequence | SEQ ID NO |
|---|---|---|---|
| PF-669 | Mycobacteria spp | RADRIESYPADGDRVITLWRNPYR | 869 |
| PF670 | Mycobacteria spp | TVIVAPMHSGV | 870 |
| PF-671 | S. mutans E. coli | TVSAFRTVH | 871 |
| PF-673 | S. mutans E. coli | VRRLRM | 872 |
| PF-674 | S. mutans E. coli | DGCDSEPALTYR | 873 |
| PF-675 | Mycobacteria spp | EIIPISPTRRCEMHTMSSAEYRGL | 874 |
| PF-676 | S. mutans E. coli | AEYRGL | 875 |
| PF-677 | Mycobacteria spp | TCRGAGMH | 876 |
| PF-678 | Mycobacteria spp | RDRRWTRRDMYDWLESARV | 877 |
| PF-679 | S. mutans E. coli | CRARFIRR | 878 |
| PF-680 | Mycobacteria spp | ADPHPTTGI | 879 |
| PF-681 | M. smegmatis | TALTTVGVSGARLITYCVGVEDI | 880 |
| PF-682 | Mycobacteria spp | RRGKSEQGLSRR | 881 |
| PF-683 | Mycobacteria spp | LWPVA | 882 |
| PF-684 | Mycobacteria spp | RKLSLASGFALWRRSLV | 883 |
| PF-685 | Mycobacteria spp | PTLWLACL | 884 |
| PF-686 | M. smegmatis | LAVLMGYIGYRGWSGKRHINRQ | 885 |
| PF-687 | Mycobacteria spp | AKRVLSLAVAPHRRQPVQGT | 886 |
| PF-688 | Mycobacteria spp | ARNHAVIPAG | 887 |
| PF-689 | S. mutans E. coli | SAPSG | 888 |
| PF-690 | Mycobacteria spp | MIPLAGDPVSSHRTVEFGVLGTYLVSGGSL | 889 |
| PF-691 | Mycobacteria spp | HRTVEFGVLGTYLVSGGSL | 890 |
| PF-692 | Mycobacteria spp | GVAREDPLEPDPLAPIIDDSR | 891 |
| PF-693 | Mycobacteria spp | PDPAR | 892 |
| PF-694 | Mycobacteria spp | DLIRPLYSMSAPSVA | 893 |
| PF-695 | Mycobacteria spp | ALSVMLGNIPLVVPNANQL | 894 |
| PF-696 | Mycobacteria spp | IRSGISAAYARPLR | 895 |
| PF-697 | Mycobacteria spp | RADARAK | 896 |
| PF-698 | Mycobacteria spp | SSGRAGVKCRRPTGR | 897 |
| PF-699 | Mycobacteria spp | GRAGVKCRRPTGR | 898 |
| PF-700 | Mycobacteria spp | LNWPFTGR | 899 |
| PF-701 | S. mutans | PRGAQSGHG | 900 |
| PF-702 | Mycobacteria spp | LSGRLAGRR | 901 |

TABLE 3-continued

Illustrative list of novel targeting peptides.

| ID | Target(s) | Targeting Peptide Sequence | SEQ ID NO |
|---|---|---|---|
| PF-703 | Mycobacteria spp | MTTVDNIVGLVIAVALMAFLFAALLFPEKF | 902 |
| PF-704 | Mycobacteria spp | APAARAAL | 903 |
| PF-705 | S. mutans<br>E. coli | GEEEGTVAD | 904 |
| PF-706 | L. pneumophila | LGYGAWIGCGLGLNGFHRID | 905 |
| PF-707 | S. mutans<br>E. coli | IDPESIVTTNNKQDNVDEQ | 906 |
| PF-709 | S. mutans | NKKHSPMD | 907 |
| PF-711 | S. mutans | KTAGPTGTIYKTN | 908 |
| PF-712 | S. mutans<br>E. coli | QIYRHVHKVQAKSANLRLY | 909 |
| PF-714 | L. pneumophila | FVVTQRMLRMYKK | 910 |
| PF-716 | S. mutans | HGENHHHKSDEKDNDSSEKKD | 911 |
| PF-717 | E. coli | PQSEVTFENIYAPKANGGGLYGI | 912 |
| PF-720 | S. mutans | SLDMGK | 913 |
| PF-724 | L. pneumophila | CYRFLTPKRPTRIS | 914 |
| PF-727 | S. mutans<br>E. coli | AYARCRHDYPFTLGQMQTH | 915 |
| PF-728 | S. mutans<br>E. coli | AIGQEQDRREYYYYSGYPYYY | 916 |
| PF-731 | L. pneumophila | RHKLIRLPLSESVFCFLNNPKI | 917 |
| PF-732 | E. coli | DRPSQTTHHTLSSSRITGPS | 918 |
| PF-733 | S. mutans<br>E. coli | VISRQMGSEAVLELFIIM | 919 |
| PF-735 | S. mutans<br>E. coli | YDPLFPNDKN | 920 |
| PF-737 | S. epidermidis<br>S. pneumoniae | KSSGSSASASSTAGGSSSK | 921 |
| PF-738 | S. epidermidis<br>C. albicans<br>C. jeikeium | KSGATSAASGAKSGASS | 922 |
| PF-741 | S. epidermidis<br>M. luteus<br>P. mirabilis<br>P. aeruginosa<br>C. albicans<br>MRSA<br>S. pneumoniae<br>E. faecalis | AKREDTVAAQIGANILNLIQ | 923 |
| PF-744 | S. epidermidis<br>M. luteus<br>E. coli<br>MRSA<br>S. pneumoniae<br>E. faecalis<br>C. jeikeium | LGVGTFVGKVLIKNQQKQKSKKKAQ | 924 |
| PF-745 | S. epidermidis<br>M. luteus<br>C. albicans | ANSQNSLFSNRSSFKSIFDKKSNITTNATTPNSNIIIN | 925 |

TABLE 3-continued

Illustrative list of novel targeting peptides.

| ID | Target(s) | Targeting Peptide Sequence | SEQ ID NO |
|---|---|---|---|
| PF-746 | S. epidermidis<br>M. luteus<br>E. coli<br>C. albicans<br>S. pneumoniae<br>E. faecalis<br>C. jeikeium | FLGNSQYFTRK | 926 |
| PF-748 | S. epidermidis<br>M. luteus<br>E. coli<br>P. aeruginosa<br>C. albicans<br>MRSA<br>S. pneumoniae<br>E. faecalis<br>C. jeikeium | FQGFFDVAVNKWWEEHNKAKLWKNV<br>KGKFLEGEGEEEDDE | 927 |
| PF-749 | S. epidermidis<br>M. luteus<br>E. coli<br>P. aeruginosa<br>C. albicans<br>S. pneumoniae<br>C. jeikeium | GVNKWWEEHNKAKLWKNVKGKFLEG<br>EGEEEDDE | 928 |
| PF-750 | M. luteus<br>C. jeikeium | AESSPAKTTA | 929 |
| PF-751 | S. epidermidis<br>E. coli<br>C. albicans<br>C. jeikeium | AESSPAQETT | 930 |
| PF-752 | S. epidermidis<br>E. coli<br>MRSA<br>S. pneumoniae<br>E. faecalis | LHVIRPRPELSELKFPITKILKVNKQGLKK | 931 |
| PF-756 | S. epidermidis<br>M. luteus<br>C. albicans<br>MRSA<br>C. jeikeium | DALLRLA | 932 |
| PF-757 | M. luteus<br>C. albicans<br>MRSA | PQAISSVQQNA | 933 |
| PF-758 | S. epidermidis<br>M. luteus<br>E. coli<br>MRSA<br>S. pneumoniae<br>E. faecalis<br>C. jeikeium | PEIIKIVSGLL | 934 |
| PF-760 | S. epidermidis<br>M. luteus | DHITLDDYEIHDGFNFELYYG | 935 |
| PF-761 | S. epidermidis<br>M. luteus<br>P. mirabilis<br>P. aeruginosa<br>C. albicans<br>MRSA<br>S. pneumoniae<br>E. faecalis | SKFELVNYASGCSCGADCKCASETECK<br>CASKK | 936 |
| PF-762 | M. luteus<br>C. albicans | PAPAPSAPAPAPEQPEQPA | 937 |
| PF-763 | S. epidermidis<br>M. luteus | GIWMARNYFHRSSIRKVYVESDKEYER<br>VHPMQKIQYEGNYKSQ | 938 |

TABLE 3-continued

Illustrative list of novel targeting peptides.

| ID | Target(s) | Targeting Peptide Sequence | SEQ ID NO |
|---|---|---|---|
| | E. coli<br>C. albicans<br>MRSA<br>S. pneumoniae<br>E. faecalis | | |
| PF-764 | S. epidermidis<br>M. luteus<br>C. albicans<br>MRSA<br>S. pneumoniae<br>E. faecalis<br>C. jeikeium | GYFEPGKRD | 939 |
| PF-765 | S. epidermidis<br>M. luteus<br>E. coli<br>MRSA<br>E. faecalis<br>C. jeikeium | YLYWEVEHKPIIAKRDAYYAQLRKQKE<br>IEEGA | 940 |
| PF-766 | S. epidermidis<br>M. luteus<br>C. albicans<br>MRSA<br>E. faecalis<br>C. jeikeium | DAYYAQLRKQKEIEEGA | 941 |
| PF-767 | S. epidermidis<br>M. luteus<br>E. coli<br>MRSA<br>S. pneumoniae<br>E. faecalis<br>C. jeikeium | DGKQGEPVALKPTDN | 942 |
| PF-768 | S. epidermidis<br>S. pneumoniae<br>E. faecalis<br>C. jeikeium | GFRGGKRGGARG | 943 |
| PF-770 | S. epidermidis<br>M. luteus<br>P. mirabilis<br>E. coli<br>P. aeruginosa<br>C. albicans<br>MRSA<br>S. pneumoniae<br>E. faecalis<br>C. jeikeium | GVGIGFIMMGVVGYAVKLVHIPIRYLIV | 944 |
| PF-772 | S. epidermidis<br>C. albicans<br>MRSA<br>S. pneumoniae<br>C. jeikeium | TKESSS | 945 |
| PF-773 | S. epidermidis<br>C. albicans<br>C. jeikeium | TLKESK | 946 |
| PF-776 | S. epidermidis<br>M. luteus<br>P. mirabilis<br>C. albicans<br>MRSA<br>S. pneumoniae<br>E. faecalis | VSILLYLSATIILPNVLRLLVARAIIVRV | 947 |
| PF-777 | Mycobacteria spp. | PGADGKLAEASAAIARLVRS | 948 |
| PF-778 | Mycobacteria spp. | MNLILTAHGT | 949 |

TABLE 3-continued

Illustrative list of novel targeting peptides.

| ID | Target(s) | Targeting Peptide Sequence | SEQ ID NO |
|---|---|---|---|
| PF-779 | Mycobacteria spp. | IYGDFFNFYLCDISLKVNGLQPGGPVRT VKLFGQPTGRCTPQ | 950 |
| PF-780 | Mycobacteria spp. | AVYDALVALAAAEHRAELATRDARAK DTYEKIGVHVVVAA | 951 |
| PF-781 | Mycobacteria spp. | PLVVVNHRRAERSRG | 952 |
| PF-782 | Mycobacteria spp. | TGPRRGIDLTSNRALSEVLDEGLELNSRK | 953 |
| PF-783 | Mycobacteria spp. | FTSEVRGVFTYRVNKAGLITNMRGYW NLDMMTFGNQE | 954 |
| PF-784 | Mycobacteria spp. | MAMTTVDNIVGLVIAVALMAFLFAALL FPEKF | 955 |
| PF-785 | Mycobacteria spp. | MRPQHSPAGKAFVVKKITHEQS | 956 |
| PF-786 | Mycobacteria spp. | LSERERRRLKRGII | 957 |
| PF-787 | Mycobacteria spp. | MTERQRRALLKQHPEVVSWSDYLEKR KRRTGTAG | 958 |
| PF-788 | Mycobacteria spp. | GLITVFAGTARILQLRRAAKKTHAAALR | 959 |
| PF-789 | Mycobacteria spp. | PRGAQSGHG | 960 |
| PF-790 | Mycobacteria spp. | PAGPDHLDQRDHR | 961 |
| PF-791 | S. mutans | IFLTTQNTDYSEHNAA | 962 |
| PF-792 | S. mutans | ALHASGIQAI | 963 |
| PF-793 | S. mutans | YTQUNNASAYAMLLTNKDTVP | 964 |
| PF-794 | S. mutans | NLYFENQGN | 965 |
| PF-795 | S. mutans | ALHKSGIQVIADWVPDQIYN | 966 |
| PF-796 | S. mutans | YTQSNIPTAYALMLSNKDSI | 967 |
| PF-797 | S. mutans | WYYFDNNGYM | 968 |
| PF-798 | S. mutans | ALHSKGIKVMADWVPDQMYA | 969 |
| PF-799 | S. mutans | YTHYNTALSYALLLTNKSSVP | 970 |
| PF-800 | S. mutans | WYYFDNNGYM | 971 |
| PF-C003 | A. naeslundii P. gingivalis S. mutans | FCSVDHDVITIAADHVKQGAEA | 972 |
| PF-C008 | A. naeslundii | AQPRRTWLVNFGEVPSPGLTNDGMPDH | 973 |
| PF-C034 | S. mutans E. coli | HPMPITVRSRKPGPLTAPSEH | 974 |
| PF-C045 | A. naeslundii T. denticola | FREGMGWPLSNEGSPTAPLPKHRNQV | 975 |
| PF-C050 | A. naeslundii S. mutans | QGLARPVLRRIPL | 976 |
| PF-C052 | A. naeslundii F. nucleatum S. mutans | SRFRNGV | 977 |
| PF-C055 | A. naeslundii F. nucleatum P. gingivalis S. mutans | YNLSIYIYFLHTITIAGLITLPFII | 978 |

TABLE 3-continued

Illustrative list of novel targeting peptides.

| ID | Target(s) | Targeting Peptide Sequence | SEQ ID NO |
|---|---|---|---|
| PF-C057 | A. naeslundii<br>F. nucleatum<br>P. gingivalis<br>S. mutans | YFWWYWVQDCIPYKNNEVWLELSNNMK | 979 |
| PF-C058 | A. naeslundii<br>F. nucleatum<br>P. gingivalis<br>S. mutans | FETGFGDGYYMSLWGLNEKDEVCKVVIPFINPELID | 980 |
| PF-C061 | A. naeslundii<br>F. nucleatum<br>P. gingivalis<br>S. mutans<br>T. denticola | TLNYKKMFFSVIFLLGLNYLICNSPLFFKQIEF | 981 |
| PF-C062 | A. naeslundii<br>F. nucleatum<br>P. gingivalis<br>S. mutans<br>T. denticola | PLARATEVVATLFIICSLLLYLTR | 982 |
| PF-C063 | A. naeslundii<br>F. nucleatum<br>S. mutans | SHFRKGD | 983 |
| PF-C064 | A. naeslundii<br>F. nucleatum<br>P. gingivalis<br>S. mutans<br>T. denticola | DEEALEMGANLYAQFAIDFLNSKK | 984 |
| PF-C065 | A. naeslundii<br>F. nucleatum<br>P. gingivalis<br>S. mutans | DEERYSDSYFLKEKVFYLILALFLILFHQKYLYFLEIITI | 985 |
| PF-C068 | A. naeslundii<br>F. nucleatum<br>S. mutans | LNLFASI | 986 |
| PF-C069 | A. naeslundii<br>F. nucleatum<br>P. gingivalis<br>S. mutans<br>T. denticola | NALMLREMQLAKNIKVEVTDVLSNKKYC | 987 |
| PF-C071 | A. naeslundii<br>F. nucleatum<br>S. mutans | QVIVKIL | 988 |
| PF-C072 | A. naeslundii<br>F. nucleatum<br>P. gingivalis<br>S. mutans<br>T. denticola | KKMFSLIRKVNWIFFILFIVLDLTNVFPLIRTILFAILSRQ | 989 |
| PF-C075 | A. naeslundii<br>F. nucleatum<br>P. gingivalis<br>S. mutans<br>T. denticola | KALVISVFAIVFSIIFVKFFYWRDKK | 990 |
| PF-C080 | A. naeslundii<br>F. nucleatum<br>S. mutans | INIPGLF | 991 |
| PF-C084 | A. naeslundii<br>F. nucleatum<br>P. gingivalis<br>S. mutans | FFSVIFLFGLNYLICNSPLFNILR | 992 |
| PF-C085 | A. naeslundii<br>F. nucleatum | KKFKIFVIINWFYHKYIILNFEENF | 993 |

TABLE 3-continued

Illustrative list of novel targeting peptides.

| ID | Target(s) | Targeting Peptide Sequence | SEQ ID NO |
|---|---|---|---|
| | P. gingivalis<br>S. mutans<br>T. denticola | | |
| PF-C086 | A. naeslundii<br>F. nucleatum<br>P. gingivalis<br>S. mutans<br>T. denticola | ELFFTILSDCNELFLLHLLQQPLFYIKKGK | 994 |
| PF-C088 | A. naeslundii<br>F. nucleatum<br>P. gingivalis<br>S. mutans<br>T. denticola | DIANNILNSVSERLIIA | 995 |
| PF-C091 | A. naeslundii<br>F. nucleatum<br>P. gingivalis<br>S. mutans<br>T. denticola | ASNTPRFVRLTLFNFYSKIWNVTHLFLF<br>NNL | 996 |
| PF-C093 | A. naeslundii<br>F. nucleatum<br>S. mutans | EKLGTMV | 997 |
| PF-C095 | A. naeslundii<br>F. nucleatum<br>P. gingivalis<br>S. mutans | LLALNMNEDTYYFELFFIFDNQNKKWL<br>IFDLKERG | 998 |
| PF-C098 | A. naeslundii<br>F. nucleatum<br>P. gingivalis<br>S. mutans<br>T. denticola | PETKGKVSAFVFGIVVANVIAVVYILYM<br>LREIGIIQ | 999 |
| PF-C120 | A. naeslundii<br>F. nucleatum<br>P. gingivalis<br>S. mutans<br>T. denticola | ASLSTMTFKVMELKELIILLCGLTMLMI<br>QTEFV | 1000 |
| PF-C131 | A. naeslundii<br>F. nucleatum<br>P. gingivalis<br>S. mutans | QWIVAKREIRMHIYCHISVIHVIIFFG | 1001 |
| PF-C134 | A. naeslundii<br>F. nucleatum<br>P. gingivalis<br>S. mutans<br>T. denticola | NELMKYPATLTATATTPGIKYSHLCSVCL | 1002 |
| PF-C135 | A. naeslundii<br>F. nucleatum<br>P. gingivalis<br>S. mutans | KNTHAYLRVLRLSSLILSYQASVYPLFA<br>YLCQQKDY | 1003 |
| PF-C136 | A. naeslundii<br>F. nucleatum<br>P. gingivalis<br>S. mutans<br>T. denticola | LILSYQASVYPLFAYLCQQKDY | 1004 |
| PF-C137 | A. naeslundii<br>F. nucleatum<br>P. gingivalis<br>S. mutans | QRMYWFKRGFETGDFSAGDTFAELK | 1005 |
| PF-C139 | A. naeslundii<br>F. nucleatum<br>P. gingivalis<br>S. mutans<br>T. denticola | LLASHPERLSLGVFFVYRVLHLLLENT | 1006 |

TABLE 3-continued

Illustrative list of novel targeting peptides.

| ID | Target(s) | Targeting Peptide Sequence | SEQ ID NO |
|---|---|---|---|
| PF-C142 | A. naeslundii<br>F. nucleatum<br>P. gingivalis<br>S. mutans<br>T. denticola | DFPPLSFFRRRFHAYTAPIDNFFGANPF | 1007 |
| PF-C143 | A. naeslundii<br>F. nucleatum<br>P. gingivalis<br>S. mutans<br>T. denticola | VVFGGGDRLV | 1008 |
| PF-C145 | A. naeslundii<br>F. nucleatum<br>P. gingivalis<br>S. mutans<br>T. denticola | YGKESDP | 1009 |
| PF-C160 | F. nucleatum | AASGFTYCASNGVWHPY | 1010 |
| PF-C180 | F. nucleatum<br>P. gingivalis<br>S. mutans<br>T. denticola | TVEELDKAFTWGAAAALAIGVIAINVG LAAGYCYNNNDVF | 1011 |
| PF-C181 | P. gingivalis | KMRAGQVVFIYKLILVLLFYVLQKLFD LKKGCF | 1012 |
| PF-C194 | A. naeslundii<br>F. nucleatum<br>P. gingivalis<br>S. mutans<br>T. denticola | NTNDLLQAFELMGLGMAGVFIVLGILYI VAELLIKIFPVNN | 1013 |
| PF-C259 | F. nucleatum<br>S. mutans | AEIQPHCLSVL | 1014 |
| PF-C271 | A. naeslundii<br>F. nucleatum<br>P. gingivalis<br>S. mutans<br>T. denticola | FFPSYYSIIITYF | 1015 |
| PF-C273 | A. naeslundii<br>P. gingivalis<br>S. mutans<br>T. denticola | KNMLKRRMKQKRLFDEEDRLRVLSKY TKSYY | 1016 |
| PF-C281 | A. naeslundii<br>F. nucleatum<br>P. gingivalis<br>S. mutans<br>T. denticola | KKEKLLTAIRLQHRAEIRGYFTIFFLFFRI | 1017 |
| PF-C285 | A. naeslundii<br>F. nucleatum<br>P. gingivalis<br>S. mutans<br>T. denticola | FTIIELKKQKIKHGENNKKTAHPLNEPF CARA | 1018 |
| PF-C290 | A. naeslundii<br>F. nucleatum<br>P. gingivalis<br>S. mutans<br>T. denticola | GNVHPESDFHNLIQFIKTFLYFTIFFKYFL | 1019 |
| PF-C291 | A. naeslundii<br>F. nucleatum<br>P. gingivalis<br>S. mutans | HPFLTGTGCPLFLIFRLFFVKAYFSFTVF | 1020 |
| PF-S003 | S. epidermidis<br>M. luteus<br>P. mirabilis | ALALLKQDLLNFEGRGRIITSTYLQFNE GCVP | 1021 |

TABLE 3-continued

Illustrative list of novel targeting peptides.

| ID | Target(s) | Targeting Peptide Sequence | SEQ ID NO |
|---|---|---|---|
| | E. coli<br>P. aeruginosa<br>C. albicans<br>MRSA<br>S. pneumoniae<br>E. faecalis<br>C. jeikeium<br>C. jejuni<br>M. smegmatis | | |
| PF-S004 | S. epidermidis<br>MRSA<br>C. jeikeium | VLLNIFRTLLEFFSPSNAPGAEDVPLPDT<br>QA | 1022 |
| PF-S007 | S. epidermidis<br>MRSA | VVAGVVLLTALAVGSKRKEKKQIKEIQ<br>RLLAATR | 1023 |
| PF-S015 | S. epidermidis<br>MRSA<br>C. jeikeium | IENLERGARRPP | 1024 |
| PF-S018 | S. epidermidis<br>M. luteus<br>C. albicans<br>MRSA<br>E. faecalis<br>C. jeikeium<br>C. jejuni | GMPQIPRLRI | 1025 |
| PF-S023 | S. epidermidis<br>MRSA | MAEDERRALKRRTNRGRTRTRKRITV | 1026 |
| PF-S026 | S. epidermidis<br>MRSA<br>C. jeikeium | TELKYNGEEYLLLTQRDILAVIEK | 1027 |
| PF-S029 | M. luteus<br>P. mirabilis<br>E. coli<br>C. albicans<br>C. jeikeium<br>C. jejuni | TSDTQSQSPWLFDNADIVNIYPVQLMHS<br>SDND | 1028 |

*Peptide binding was conducted in aqueous buffers that varied depending on peptide solubility. For example: Brain Heart Infusion (BHI) Media; 1x Phosphate-buffered saline (PBS); 0.05% v/v Tween-20; 0.05% v/v Tween-80; 1% v/v Glycerol; 50 µM Guanidine hydrochloride; 0.05% v/v Acetic acid; 50 µM Urea; 1% v/v Polyethylene glycol 400 (PEG 400); 20 mM Sodium glutamate; 50 mM Piperazine-1,4-bis(2-ethanesulfonic acid) (PIPES); 50 mM Sodium acetate; 1% v/v Pluronic 17R4; 1% w/v Pluronic F108; 1% w/v Pluronic P123; 0.2% v/v Cetyl trimethylammonium bromide (CTAB); 0.8% v/v β-D-Octyl glucoside (BOG); 0.2% CTAB and 0.05% Tween-20; 0.2% CTAB and 0.05% Tween-80; 0.2% CTAB and 1% glycerol; and 20 mM HEPES (4-(2-hydroxyethyl)-1- piperazineethanesulfonic acid), 150 mM sodium chloride, 1 mM magnesium chloride and 0.1% CTAB. Preferably, binding was evaluated in 1x PBS.
**Three-amino acid code: Dab: Diaminobutyric acid; Orn: Ornithine; cDOrn, cOrn: side-chain cyclical Ornithine; Abreviations: c(X . . . Y) indicates amino acids are cyclic, connected X to Y; DX indicates D-isoform amino acids.

In certain embodiments, the amino acid sequence of the targeting peptides comprises or consists of a single amino acid sequence, e.g., as listed above in Table 3. In certain embodiments the amino acid sequence of the targeting peptides comprises two copies, three copies, four copies, five copies six copies or more of one or more of the amino acid sequences listed in Table 3, and/or Table 10, and/or Table 12. Thus, compound targeting constructs are contemplated where the construct comprises multiple domains each having targeting activity. The targeting domains comprising such a construct can be the same or different. In certain embodiments the construct comprises at least 2, at least 3, at least 4, at least 5, at least 6, at least 7, or at least 8 different targeting domains each domain comprising a different targeting sequence.

Various targeting domains comprising such a construct can be joined directly to each other or two or more of such domains can be attached to each other via a linker. An illustrative, but non-limiting, list of suitable linkers is provided in Table 16. Thus, in certain embodiments, two or more targeting domains comprising a compound/multiple targeting construct are chemically conjugated together.

In certain embodiments the two or more targeting domains comprising the construct are joined by a peptide linker. Where all the targeting domains are attached directly to each other or are joined by peptide linkers, the entire construct can be provided as a single-chain peptide (fusion protein).

In various embodiments, the targeting peptides described herein comprise one or more of the amino acid sequences shown in Table 3, and/or Table 10, and/or Table 12 (and/or the retro, inverso, retroinverso, etc. forms of such sequences). In certain embodiments the peptides range in length up to about 100 amino acids in length, preferably up to about 80, about 70, about 60, about 51 amino acids in length. In certain embodiments the peptides range in length from about 8 amino acids up to about 100 amino acids 80 amino acids, 60 amino acids or about 51 amino acids in length. In certain embodiments the peptides range in length from about 8 up to about 50, 40, 30, 20, 15, 15, 13, or 12 amino acids in length.

As shown in Tables 3, 10, and 12 the various amino acid sequences described herein target particular microorganisms. The range of activity of the peptides or compositions comprising such peptides can be increased by including amino acid sequences that target different microorganisms either as separate components and/or as multiple domains within a single construct.

In some embodiments greater specificity and/or avidity can be obtained by including multiple different amino acid sequences that target the same microorganism.

II. Antimicrobial Peptides.

A) Uses of Antimicrobial Peptides.

The antimicrobial peptides described herein also have a wide variety of uses. For example, the peptides can be formulated individually, in combination, in combination with other antimicrobial peptides, and/or in combination with various antibacterial agents to provide antimicrobial pharmaceuticals.

In various embodiments, the antimicrobial peptides described herein can be formulated individually, in combination, in combination with other antimicrobial peptides, and/or in combination with various antibiotic (e.g., antibacterial) agents in "home healthcare" formulations. Such formulations include, but are not limited to toothpaste, mouthwash, tooth whitening strips or solutions, contact lens storage, wetting, or cleaning solutions, dental floss, toothpicks, toothbrush bristles, oral sprays, oral lozenges, nasal sprays, aerosolizers for oral and/or nasal application, wound dressings (e.g., bandages), and the like.

In various embodiments the antimicrobial peptides described herein can be formulated individually, in combination, in combination with other antimicrobial peptides, and/or in combination with various antibiotic (e.g., antibacterial) agents in various cleaning and/or sterilization formulations for use in agriculture, in fool preparation and transport, in the home, workplace, clinic, or hospital.

In certain embodiments the antimicrobial peptides described herein are attached to one or more targeting moieties to specifically and/or to preferentially deliver the peptide(s) to a target (e.g. a target microorganism, biofilm, bacterial film, particular tissue, etc.).

Other possible uses of the targeting and/or antimicrobial peptides disclosed herein include, but are not limited to biofilm dispersal, biofilm retention, biofilm formation, anti-biofilm formation, cell agglutination, induction of motility or change in motility type, chemoattractant or chemorepellent, extracellular signal for sporogenesis or other morphological change, induction or inhibition of virulence gene expression, utilized as extracellular scaffold, adhesin or binding site, induction or suppression of host immune response, induction or suppression of bacterial/fungal antimicrobial molecule production, quorum-sensing, induction of swarming behavior, apoptosis or necrosis inducing in eukaryotic cells, affecting control of or inducing the initiation of cell cycle in eukaryotes, in archaea or prokaryotes, induces autolysis or programmed cell death, inhibition of phage/virus attachment or replication, evasion of innate immunity, induction or inhibition of genetic transformation or transduction competence, induction or inhibition of pilus-mediated conjugation, induction or inhibition of mating behavior in bacteria and fungi, induction or inhibition of nodule formation or metabolic compartmentalization, metal, ion, or nutrient binding, acquisition or inhibition of metal, ion, or nutrient binding and acquisition, and the like.

In certain embodiments, compositions and methods are provided for decreasing the infectivity, morbidity, and rate of mortality associated with a variety of pathogens. The present invention also relates to methods and compositions for decontaminating areas, samples, solutions, and foodstuffs colonized or otherwise infected by pathogens and microorganisms. Certain embodiments of the present compositions are nontoxic and may be safely ingested by humans and other animals. Additionally, certain embodiments of the present invention are chemically stable and non-staining.

In some embodiments, the present invention provides compositions and methods suitable for treating animals, including humans, exposed to pathogens or the threat of pathogens. In some embodiments, the animal is contacted with effective amounts of the compositions prior to exposure to pathogenic organisms. In other embodiments, the animal or human is contacted with effective amounts of the compositions after exposure to pathogenic organisms. Thus, the present invention contemplates both the prevention and treatment of microbiological and other infections.

In certain embodiments compositions and methods are provided for decontaminating solutions and surfaces, including organic and inorganic samples that are exposed to pathogens or suspected of containing pathogens. In still other embodiments of the present invention, the compositions are used as additives to prevent the growth of harmful or undesired microorganisms in biological and environmental samples.

These applications of the peptides described herein are intended to be illustrative and not limiting. Using the teaching provided herein, other uses will be recognized by one of skill in the art.

B Illustrative Novel Antimicrobial Peptides.

Antimicrobial peptides (also called host defense peptides) are an evolutionarily conserved component of the innate immune response and are found among all classes of life. Unmodified, these peptides are potent, broad spectrum antibiotics which demonstrate potential as novel therapeutic agents. Antimicrobial peptides have been demonstrated to kill Gram-negative and Gram-positive bacteria (including strains that are resistant to conventional antibiotics), mycobacteria (including *Mycobacterium tuberculosis*), enveloped viruses, and fungi.

Naturally-occurring antimicrobial peptides are typically short peptides, generally between 12 and 50 amino acids. These peptides often include two or more positively charged residues provided by arginine, lysine or, in acidic environments, histidine, and frequently a large proportion (generally >50%) of hydrophobic residues (see, e.g., Papagianni et al. (2003) *Biotechnol Adv* 21: 465; Sitaram and Nagaraj (2002) *Curr Pharm Des* 8: 727; Dürr et al. (2006) *Biochim. Biophys. Acta* 1758: 1408-1425).

Frequently the secondary structures of these molecules follow 4 themes, including i) α-helical, ii) β-stranded due to the presence of 2 or more disulfide bonds, iii) β-hairpin or loop due to the presence of a single disulfide bond and/or cyclization of the peptide chain, and iv) extended. Many of these peptides are unstructured in free solution, and fold into their final configuration upon partitioning into biological membranes. The ability to associate with membranes is a definitive feature of antimicrobial peptides although membrane permeabilisation is not necessary. These peptides have a variety of antimicrobial activities ranging from membrane permeabilization to action on a range of cytoplasmic targets.

The modes of action by which antimicrobial peptides kill bacteria is varied and includes, but is not limited to disrupting membranes, interfering with metabolism, and targeting cytoplasmic components. In many cases the exact mechanism of killing is not known.

In certain embodiments the antimicrobial peptides include peptides comprising or consisting of one or more of the amino acid sequences shown in Tables 4 (SEQ ID NOs:1029-1078), and/or Table 5 (SEQ ID NOs:1079-1566). In various embodiments the peptides include peptides comprising or consisting of the retro, inverso, retro-inverso, and/or beta form of one or more of the amino acid sequences shown in Tables 4 (SEQ ID NOs:1029-1078), and/or Table 5 (SEQ ID NOs:1079-1566). The peptides can comprise all "L" amino acids, all "D" amino acids, or combinations of "L" and "D" amino acids. Also contemplated are circular permutations of these sequences as well as peptides comprising or consisting of the retro, inverso, retro-inverso, and/or beta form of such circular permutations.

It will also be recognized, that in certain embodiments, any peptide or compound AMP described herein can be circularized.

In various embodiments the peptides can optionally bear one or more protecting groups, e.g., and the amino and/or carboxyl termini, and/or on side chains.

Also contemplated are peptides comprising one, two, three four, or five conservative substitutions of these amino acid sequences.

TABLE 4

Novel antimicrobial peptides, target microorganisms and MIC values.

| ID | Organism MIC (µM) | Structure/sequence | SEQ ID NO |
|---|---|---|---|
| K-1 | S. mutans, 25 | GLGRVIGRLIKQIIWRR | 1029 |
| K-2 | S. mutans, 12.5 | VYRKRKSILKIYAKLKGWH | 1030 |
| K-7 | S. mutans, 12.5 | NYRLVNAIFSKIFKKKFIKF | 1031 |
| K-8 | S. mutans, 4 | KILKFLFKKVF | 1032 |
| K-9 | S. mutans, 4 | FIRKFLKKWLL | 1033 |
| K-10 | S. mutans, 4 | KLFKFLRKHLL | 1034 |
| K-11 | S. mutans, 4 | KILKFLFKQVF | 1035 |
| K-12 | S. mutans, 8 | KILKKLFKFVF | 1036 |
| K-13 | S. mutans, 16 | GILKKLFTKVF | 1037 |
| K-14 | S. mutans, 8 | LRKFLHKLF | 1038 |
| K-15 | S. mutans, 4 | LRKNLRWLF | 1039 |
| K-16 | S. mutans, 8<br>P. aeruginosa, 12.5<br>MRSA, 25 | FIRKFLQKLHL | 1040 |
| K-17 | S. mutans, 8 | FTRKFLKFLHL | 1041 |
| K-18 | S. mutans, 16 | KKFKKFKVLKIL | 1042 |
| K-19 | S. mutans, 16 | LLKLLKLKKLKF | 1043 |
| K-20 | S. mutans, 8 | FLKFLKKFFKKLKY | 1044 |
| K-21 | S. mutans, 8 | GWLKMFKKIIGKFGKF | 1045 |
| K-22 | S. mutans, 8 | GIFKKFVKILYKVQKL | 1046 |
| 1T-88 |  | GRLVLEITADEVKALGEALANAKI | 1047 |
| PF-531 | A. baumannii, 25<br>P. aeruginosa, 50<br>T. rubrum, 50<br>A. niger, 25<br>B. subtilis, 25<br>C. difficile, 12.5<br>C. jeikeium, 6.25<br>S. epidermidis, 50<br>S. mutans, 12.5 | YIQFHLNQQPRPKVKKIKIFL-NH2 | 1048 |
| PF-527 | P. aeruginosa, 50<br>T. rubrum, 25<br>A. niger, 50<br>B. subtilis, 12.5<br>C. jeikeium, 6.25<br>MRSA, 50<br>S. epidermidis, 25 | GSVIKKRRKRMAKKKHRKLLKKTRIQR RRAGK | 1049 |

TABLE 4-continued

Novel antimicrobial peptides, target microorganisms and MIC values.

| ID | Organism MIC (μM) | Structure/sequence | SEQ ID NO |
|---|---|---|---|
| PF-672 | C. albicans, 1.56<br>T. rubrum, 0.78<br>A. niger, 3<br>B. subtilis, 0.78<br>E. faecalis, 3.13<br>MRSA, 1.56<br>S. epidermidis, 0.39 | MRFGSLALVAYDSAIKHSWPRPSSVRR<br>LRM | 1050 |
| PF-606 | E. coli, 50<br>MRSA, 50<br>S. epidermidis, 50<br>S. mutans, 50<br>S. pneumoniae, 50 | FESKILNASKELDKEKKVNTALSFNSHQ<br>DFAKAYQNGKI | 1051 |
| PF-547 | T. rubrum, 25<br>B. subtilis, 25<br>S. mutans, 12.5 | WSRVPGHSDTGWKVWHRW-NH2 | 1052 |
| PF-006 | A. baumannii, 50<br>B. subtilis, 25<br>MRSA, 50 | MGIIAGIIKFIKGLIEKFTGK | 1053 |
| PF-545 | A. niger, 50<br>B. subtilis, 25<br>MRSA, 50 | RESKLIAMADMIRRRI-NH2 | 1054 |
| PF-278 | C. albicans, 50<br>T. rubrum, 50<br>S. epidermidis, 50 | LSLATFAKIFMTRSNWSLKRFNRL | 1055 |
| PF-283 | T. rubrum, 50<br>B. subtilis, 50<br>S. epidermidis, 50 | MIRIRSPTKKKLNRNSISDWKSNTSGRF<br>FY | 1056 |
| PF-307 | C. albicans, 50<br>T. rubrum, 50<br>B. subtilis, 50 | MKRRRCNWCGKLFYLEEKSKEAYCCK<br>ECRKKAKKVKK | 1057 |
| PF-168 | T. rubrum, 50<br>A. niger, 50<br>MRSA, 50 | VLPFPAIPLSRRRACVAAPRPRSRQRAS | 1058 |
| PF-538 | A. baumannii, 25<br>C. difficile, 25 | KNKKQTDILEKVKEILDKKKKTKSVGQ<br>KLY | 1059 |
| PF-448 | A. niger, 25<br>S. pneumoniae, 50 | SLQSQLGPCLHDQRH | 1060 |
| PF-583 | MRSA, 50<br>S. epidermidis, 50 | KFQGEFTNIGQSYIVSASHMSTSLNTGK | 1061 |
| PF-600 | E. coli, 50<br>S. pneumoniae, 50 | TKKIELKRFVDAFVKKSYENYILERELK<br>KLIKAINEELPTK | 1062 |
| PF-525 | A. niger, 50<br>S. pneumoniae, 50 | KFSDQIDKGQDALKDKLGDL | 1063 |
| PF-529 | A. niger, 50<br>S. pneumoniae, 50 | LSEMERRRLRKRA-NH2 | 1064 |
| PF-148 | A. niger, 50<br>B. subtilis, 50 | RRGCTERLRRMARRNAWDLYAEHFY | 1065 |
| PF-530 | A. baumannii, 25 | SKFKVLRKIIIKEYKGELMLSIQKQR | 1066 |
| PF-522 | C. difficile, 25 | FELVDWLETNLGKILKSKSA-NH2 | 1067 |
| PF-497 | B. subtilis, 50 | LVLRICTDLFTFIKWTIKQRKS | 1068 |
| PF-499 | B. subtilis, 50 | VYSFLYVLVIVRKLLSMKKRIERL | 1069 |
| PF-322 | B. subtilis, 50 | GIVLIGLKLIPLLANVLR | 1070 |

TABLE 4-continued

Novel antimicrobial peptides, target microorganisms and MIC values.

| ID | Organism MIC (µM) | Structure/sequence | SEQ ID NO |
|---|---|---|---|
| PF-511 | S. pneumoniae, 50 | VMQSLYVKPPLILVTKLAQQN | 1071 |
| PF-512 | S. pneumoniae, 50 | SFMPEIQKNTIPTQMK | 1072 |
| PF-520 | S. pneumoniae, 50 | LGLTAGVAYAAQPTNQPTNQPTNQPTN QPTNQPTNQPRW-NH2 | 1073 |
| PF-521 | S. pneumoniae, 50 | CGKLLEQKNFFLKTR | 1074 |
| PF-523 | S. pneumoniae, 50 | ASKQASKQASKQASKQASRSLKN HLL | 1075 |
| PF-524 | S. pneumoniae, 50 | PDAPRTCYHKPILAALSRIVVTDR | 1076 |
| PF-209 | MRSA, 50 | NYAVVSHT | 1077 |
| PF-437 | S. pneumoniae, 50 | FQKPFTGEEVEDFQDDDEIPTII | 1078 |

Where protecting groups are shown (e.g., —NH$_2$) they are optional. Conversely any peptide shown without protecting groups can bear one or more such groups.

In certain embodiments peptides that induce alterations in phenotype or other biological activities can also be used as antimicrobial effector moieties. Illustrative alternative peptides are shown in Table 5.

TABLE 5

Illustrative list of novel morphology, biofilm and growth disrupting peptides.

| ID | Organism, effect | Structure/sequence | SEQ ID NO |
|---|---|---|---|
| G-1 | S. mutans: Ca2+ binding | DSSQSDSDSDSNSSNTNSNSSITNG | 1079 |
| G-2 | S. mutans: biofilm structure | LPGTLHIQAEFPVQLEAGSLIQIFD | 1080 |
| G-4 | S. mutans: Biofilm structure | EIPIQLANDLANYYDISLDSIFFW | 1081 |
| G-5 | M. xanthus: Altered cell morphology | RDMTVAGKRPNFLIITTDEE | 1082 |
| G-6 | M. xanthus: Altered cell morphology | NTSIVCAVTFAPIKEVPLLWRAGLTLRS RQS | 1083 |
| G-7 | M. xanthus: Altered cell morphology | QAKVEREVERDLVYTLRRLCDPSGSER TK | 1084 |
| G-8 | S. mutans: Altered biofilm structure | PRMIDIISPHGCHGDHQVWTDPQATAL PR | 1085 |
| PF-001 | S. epidermidis (C) M. luteus (C) MRSA (R) C. jeikeium (D) | MNNWIIVAQLSVTVINEIIDIMKEKQKG GK | 1086 |
| PF-002 | B. subtilis (R) S. pneumoniae (H) | NDDAQ | 1087 |
| PF-003 | S. epidermidis (D) M. luteus (A) | MNNWIKVAQISVTVINEVIDIMKEKQN GGK | 1088 |

TABLE 5-continued

Illustrative list of novel morphology, biofilm and growth disrupting peptides.

| ID | Organism, effect | Structure/sequence | SEQ ID NO |
|---|---|---|---|
| | MRSA (R) C. jeikeium (A) | | |
| PF-004 | S. epidermidis (A) M. luteus (A) MRSA (R) C. jeikeium (A) | ARLSKAIIIAVIVVYHLDVRGLF | 1089 |
| PF-005 | B. subtilis (C) S. pneumoniae (H) | MESIFKIKLMNGICRSENMNMKKKNK GEKI | 1090 |
| PF-006 | S. epidermidis (D) M. luteus (A) B. subtilis (I) MRSA (I) S. pneumoniae (R) C. jejuni (D) | MGIIAGIIKFIKGLIEKFTGK | 1091 |
| PF-007 | S. epidermidis (A) M. luteus (A) E. coli (A) MRSA (R) E. faecalis (A) | MGIIAGIIKVIKSLIEQFTGK | 1092 |
| PF-008 | B. subtilis (D) C. jejuni (R) | MIEIGSIAYLNGGSKKYNHILNQENR | 1093 |
| PF-009 | S. epidermidis (S) | SKKYNHILNQENR | 1094 |
| PF-010 | S. epidermidis (S) M. luteus (A) MRSA (R) C. jeikeium (A) | MDIDVNKLLQAFVYFKSFEKLRHNNS | 1095 |
| PF-011 | MRSA (R) C. jeikeium (C) | MFCYYKQHKGDNFSIEEVKNIIADNEM KVN | 1096 |
| PF-012 | S. epidermidis (S) M. luteus (C) MRSA (R) C. jeikeium (A) | WRGPNTEAGGKSANNIVQVGGAPT | 1097 |
| PF-013 | S. epidermidis (C) M. luteus (D) MRSA (R) C. jeikeium (D) | LIQKGLNQTFIVVIRLNNFIKKS | 1098 |
| PF-015 | MRSA (W) | SIDKRNLYNLKYYE | 1099 |
| PF-017 | MRSA (M) | ESIIE | 1100 |
| PF-019 | MRSA (M) | NDTNK | 1101 |
| PF-020 | S. mutans (F) S. epidermidis (C) M. luteus (C) MRSA (C) S. pneumoniae (D) | MKIILLLFLIFGFIVVVTLKSEHQLTLFSI | 1102 |
| PF-021 | S. epidermidis (A) M. luteus (A) MRSA (R) C. jeikeium (R) | FSLNFSKQKYVTVN | 1103 |
| PF-022 | S. epidermidis (D) M. luteus (A) MRSA (R) C. jeikeium (A) | MINELKNKNSGIMNNYVVTKESKL | 1104 |
| PF-023 | MRSA (S) | MTKNTIISLENEKTQINDSENESSDLRK AK | 1105 |
| PF-024 | S. epidermidis (D) MRSA (M) | DLRKAK | 1106 |

TABLE 5-continued

Illustrative list of novel morphology, biofilm and growth disrupting peptides.

| ID | Organism, effect | Structure/sequence | SEQ ID NO |
|---|---|---|---|
| PF-025 | S. epidermidis (S)<br>M. luteus (A)<br>MRSA (R)<br>C. jeikeium (A) | LLIIFRLWLELKWKNKK | 1107 |
| PF-026 | MRSA (M) | SIHFIN | 1108 |
| PF-027 | S. epidermidis (D)<br>MRSA (M) | HNARKYLEFISQKIDGDKLTKEDSL | 1109 |
| PF-028 | S. epidermidis (M)<br>MRSA (R)<br>C. jeikeium (M) | ALDCSEQSVILWYETILDKIVGVIK | 1110 |
| PF-029 | MRSA (M) | NSTNE | 1111 |
| PF-030 | S. epidermidis (D)<br>M. luteus (C)<br>MRSA (R)<br>C. jeikeium (C) | MTCHQAPTTTHQSNMA | 1112 |
| PF-031 | MRSA (M) | MPHHSTTSSRIVVPAHQSNMASTPNLSITP | 1113 |
| PF-032 | S. epidermidis (S)<br>C. jeikeium (C) | RIVVPAHQSNMASTPNLSITP | 1114 |
| PF-033 | S. epidermidis (M)<br>B. subtilis (C)<br>MRSA (M)<br>S. pneumoniae (R)<br>C. jeikeium (D)<br>C. jejuni (R) | MFIFKTTSKSHFHNNVKSLECIKIPINKNR | 1115 |
| PF-034 | S. epidermidis (A) | EPKKKHFPKMESASSEP | 1116 |
| PF-035 | MRSA (M) | SFYESY | 1117 |
| PF-036 | S. epidermidis (S)<br>M. luteus (A)<br>MRSA (R)<br>C. jeikeium (A) | ILNRLSRIVSNEVTSLIYSLK | 1118 |
| PF-037 | S. epidermidis (D)<br>M. luteus (C)<br>MRSA (R)<br>C. jeikeium (D) | MTKKRRYDTTEFGLAHSMTAKITLHQALYK | 1119 |
| PF-040 | S. mutans (F)<br>S. epidermidis (D) FNV<br>M. luteus (D)<br>B. subtilis (D)<br>P. mirabilis (C)<br>E. coli (C)<br>MRSA (D)<br>S. pneumoniae (D)<br>C. jeikeium (D)<br>C. jejuni (D) | MIHLTKQNTMEALHFIKQFYDMFFILN | 1120 |
| PF-041 | S. epidermidis (R)<br>MRSA (M) | ELLVILPGFI | 1121 |
| PF-042 | S. epidermidis (D)<br>M. luteus (C)<br>MRSA (R)<br>C. jeikeium (S) | LLLSYFRYTGALLQSLF | 1122 |
| PF-043 | S. epidermidis (D)<br>M. luteus (C)<br>MRSA (R)<br>C. jeikeium (A) | MIKNETAYQMNELLVIRSAYAK | 1123 |
| PF-045 | MRSA (S) | LDINDYRSTY | 1124 |

TABLE 5-continued

Illustrative list of novel morphology, biofilm and growth disrupting peptides.

| ID | Organism, effect | Structure/sequence | SEQ ID NO |
|---|---|---|---|
| PF-046 | S. epidermidis (C)<br>MRSA (R)<br>C. jeikeium (R) | LDFYLTKHLTLML | 1125 |
| PF-048 | S. epidermidis (D)<br>MRSA (W)<br>C. jeikeium (S) | LYFAFKKYQERVNQAPNIEY | 1126 |
| PF-049 | MRSA (S) | AYYLKRREEKGK | 1127 |
| PF-051 | S. mutans (D)<br>S. epidermidis (D)<br>M. luteus (C)<br>MRSA (D)<br>S. pneumoniae (D) | RFFNFEIKKSTKVDYVFAHVDLSDV | 1128 |
| PF-052 | S. epidermidis (S)<br>M. luteus (A)<br>MRSA (R)<br>C. jeikeium (D) | QELINEAVNLLVKSK | 1129 |
| PF-053 | S. epidermidis (C)<br>M. luteus (D)<br>B. subtilis (H)<br>E. coli (A)<br>P. aeruginosa (A)<br>C. albicans (A)<br>MRSA (D)<br>S. pneumoniae (S)<br>E. faecalis (A)<br>C. jeikeium (D)<br>C. jejuni (D) | KLFGQWGPELGSIYILPALIGSIILIAIVT<br>LILRAMRK | 1130 |
| PF-056 | S. epidermidis (D)<br>M. luteus (D)<br>B. subtilis (C)<br>C. albicans (B)<br>MRSA (M)<br>S. pneumoniae (D)<br>C. jeikeium (S)<br>C. jejuni (D) | AEQLFGKQKQRGVDLFLNRLTIILSILF<br>FVLMICISYLGM | 1131 |
| PF-057 | S. epidermidis (D)<br>M. luteus (C)<br>E. coli (M)<br>C. albicans (A)<br>MRSA (M)<br>S. pneumoniae (R)<br>E. faecalis (A)<br>C. jeikeium (A)<br>C. jejuni (D) | TMIVISIPRFEEYMKARHKKWM | 1132 |
| PF-058 | MRSA (M) | FADQSQDNA | 1133 |
| PF-059 | C. jejuni (C) | TITLKAGIERALHEEVPGVIEVEQVF | 1134 |
| PF-061 | S. epidermidis (R)<br>B. subtilis (R)<br>S. pneumoniae (R)<br>C. jejuni (R) | GYNSYKAVQDVKTHSEEQRVTAKK | 1135 |
| PF-063 | S. epidermidis (R)<br>M. luteus (R)<br>B. subtilis (C)<br>P. aeruginosa (A)<br>MRSA (M)<br>S. pneumoniae (D)<br>C. jeikeium (D)<br>C. jejuni (D) | IAAIIVLVLFQKGLLQIFNWILIQLQ | 1136 |
| PF-064 | S. epidermidis (D)<br>MRSA (M) | DYYGKE | 1137 |

TABLE 5-continued

Illustrative list of novel morphology, biofilm and growth disrupting peptides.

| ID | Organism, effect | Structure/sequence | SEQ ID NO |
|---|---|---|---|
| PF-065 | S. epidermidis (D)<br>MRSA (R)<br>C. jeikeium (A) | LEKNTRDNYFIHAIDRIYINTSKGLFPES<br>ELVAWG | 1138 |
| PF-066 | MRSA (S) | IKGTVKAVDETTVVITVNGHGTELTFE<br>KPAIKQVDPS | 1139 |
| PF-067 | S. epidermidis (D)<br>M. luteus (R)<br>B. subtilis (C)<br>P. aeruginosa (A)<br>MRSA (M)<br>S. pneumoniae (D)<br>C. jeikeium (D)<br>C. jejuni (D) | DLIVKVHICFVVKTASGYCYLNKREAQ<br>AAI | 1140 |
| PF-068 | S. epidermidis (M)<br>M. luteus (D)<br>B. subtilis (A)<br>E. coli (A)<br>MRSA (M)<br>S. pneumoniae (D)<br>E. faecalis (A)<br>C. jeikeium (R)<br>C. jejuni (D) | SHLINNFGLSVINPSTPICLNFSPVFNLL<br>TVYGITCN | 1141 |
| PF-069 | B. subtilis (D)<br>C. jejuni (R) | FDPVPLKKDKSASKHSHKHNH | 1142 |
| PF-070 | B. subtilis (D) | SMVKSEIVDLLNGEDNDD | 1143 |
| PF-071 | S. epidermidis (R)<br>M. luteus (R)<br>B. subtilis (D)<br>C. albicans (B)<br>MRSA (C)<br>S. pneumoniae (A)<br>C. jejuni (A) | HCVIGNVVDIANLLKRRAVYRDIADVI<br>KMR | 1144 |
| PF-073 | S. epidermidis (R)<br>M. luteus (R)<br>MRSA (M)<br>S. pneumoniae (D)<br>C. jeikeium (D)<br>C. jejuni (D) | CPSVTMDACALLQKFDFCNNISHFRHF<br>FAIKQPIER | 1145 |
| PF-074 | S. epidermidis (D)<br>MRSA (M) | RDIHPIYFMTKD | 1146 |
| PF-075 | S. epidermidis (D)<br>M. luteus (A)<br>MRSA (R)<br>C. jeikeium (D) | FVNSLIMKDLSDNDMRFKYEYYNREK<br>DT | 1147 |
| PF-076 | S. epidermidis (S)<br>M. luteus (A)<br>MRSA (R)<br>C. jeikeium (A) | LYQYELLSKEEYLKCTLIINQRRNEQK | 1148 |
| PF-099 | S. epidermidis (D)<br>C. jeikeium (C) | EIIAYLEGRFANA | 1149 |
| PF-123 | S. epidermidis (M) | TTRPQVAEDRQLDDALKETFPASDPISP | 1150 |
| PF-124 | S. epidermidis (C)<br>C. jeikeium (R) | MADGQIAAIAKLHGVPVATRNIRHFQS<br>FGVELINPWSG | 1151 |
| PF-125 | S. epidermidis (D)<br>M. luteus (C) | YVVGALVILAVAGLIYSMLRKA | 1152 |
| PF-127 | S. epidermidis (M)<br>M. luteus (A)<br>C. jeikeium (A) | MLRYLSLFAVGLATGYAWGWIDGLA<br>ASLAV | 1153 |

TABLE 5-continued

Illustrative list of novel morphology, biofilm and growth disrupting peptides.

| ID | Organism, effect | Structure/sequence | SEQ ID NO |
|---|---|---|---|
| PF-128 | S. epidermidis (D)<br>P. aeruginosa (C) | GIKVVAARFEEIQFSENFDSIILA | 1154 |
| PF-129 | S. epidermidis (M)<br>C. jeikeium (R) | MKLLARDPWVCAWNDIW | 1155 |
| PF-133 | C. jeikeium (R) | GDPTAGQKPVECP | 1156 |
| PF-135 | C. jeikeium (R) | PPARPARIPQTPTLHGASLFRQRS | 1157 |
| PF-137 | S. epidermidis (D)<br>M. luteus (D)<br>C. jeikeium (A) | VLGKGHDLLDVGKTALKSRVFAWLG<br>GS | 1158 |
| PF-139 | S. epidermidis (M)<br>M. luteus (C)<br>C. jeikeium (R) | ALSKPAIQARTLCRRQDPP | 1159 |
| PF-140 | S. epidermidis (D)<br>M. luteus (R)<br>P. aeruginosa (A)<br>C. albicans (B)<br>MRSA (M)<br>S. pneumoniae (D)<br>C. jeikeium (D)<br>C. jejuni (D) | FHRRVIRASEWALTTRSFSTPLRSAAR | 1160 |
| PF-143 | P. aeruginosa (C) | LSPRPIIVSRRSRADNNNDWSR | 1161 |
| PF-144 | S. pneumoniae (H) | RSGQPVGRPSRRAWLR | 1162 |
| PF-145 | S. epidermidis (D)<br>M. luteus (A)<br>B. subtilis (C)<br>MRSA (M)<br>S. pneumoniae (R)<br>C. jeikeium (R)<br>C. jejuni (R) | GIVLTGRAGLVSGACSMALGVGLG | 1163 |
| PF-148 | S. epidermidis (D)<br>M. luteus (A)<br>B. subtilis (I)<br>C. albicans (B)<br>MRSA (C)<br>S. pneumoniae (R)<br>C. jeikeium (H)<br>C. jejuni (H) | RRGCTERLRRMARRNAWDLYAEHFY | 1164 |
| PF-149 | MRSA (H) | GKVSVLTRVPRSLGGAPANQ | 1165 |
| PF-153 | S. epidermidis (M)<br>C. jeikeium (C) | GILARADCSQIA | 1166 |
| PF-156 | MRSA (H) | LITAEQPATAPIAGK | 1167 |
| PF-157 | S. epidermidis (M) | HTAVVWLAGVSGCVALSHCEPA | 1168 |
| PF-164 | C. jeikeium (R) | EEVSRALAGIGLGLGCRIG | 1169 |
| PF-168 | P. aeruginosa (H)<br>MRSA (I) | VLPFPAIPLSRRRACVAAPRPRSRQRAS | 1170 |
| PF-171 | S. epidermidis (R)<br>M. luteus (R)<br>B. subtilis (D)<br>MRSA (M)<br>S. pneumoniae (D)<br>C. jejuni (R) | TQVTLCRTW | 1171 |
| PF-173 | S. epidermidis (A)<br>C. jeikeium (D) | AGRTAIVQGGG | 1172 |
| PF-175 | M. luteus (S)<br>B. subtilis (D) | RRRPAGQRPEKASQAMIAA | 1173 |

TABLE 5-continued

Illustrative list of novel morphology, biofilm and growth disrupting peptides.

| ID | Organism, effect | Structure/sequence | SEQ ID NO |
|---|---|---|---|
| | C. albicans (B)<br>S. pneumoniae (A)<br>C. jejuni (M) | | |
| PF-176 | S. epidermidis (C)<br>M. luteus (C)<br>C. jeikeium (D) | RLTSNQFLTRITPFVFAQH | 1174 |
| PF-178 | S. epidermidis (D)<br>E. coli (C)<br>MRSA (M)<br>S. pneumoniae (D) | EVYSSPTNNVAITVQNN | 1175 |
| PF-180 | S. epidermidis (C) | SGLGDLGFSSEAK | 1176 |
| PF-186 | S. epidermidis (C)<br>C. jeikeium (A) | DADKNLSLERDRFAWRVAAP | 1177 |
| PF-188 | C. jeikeium (H) | ARTFAGRLGTRYFGGLMRSTKA | 1178 |
| PF-190 | S. epidermidis (C)<br>C. jeikeium (R) | HFILRKPLLFMIHSLKTGPLDRF | 1179 |
| PF-191 | S. epidermidis (A)<br>MRSA (H)<br>C. jeikeium (R) | QFCNFAWLFLASNNAQVSALA | 1180 |
| PF-192 | S. epidermidis (D) | VEEDEAPPPHY | 1181 |
| PF-196 | S. epidermidis (C)<br>C. jeikeium (R) | TTARYIRRQCHTSITPLSQG | 1182 |
| PF-199 | S. epidermidis (C)<br>M. luteus (A)<br>C. jeikeium (R) | FPAFSFGAIAGSVSVAR | 1183 |
| PF-203 | S. epidermidis (A)<br>C. jeikeium (R) | SWKCHHLAI | 1184 |
| PF-204 | S. epidermidis (C)<br>M. luteus (C)<br>P. aeruginosa (H)<br>C. jeikeium (D) | ALQKQDMNLPSVKNQLVFLKSTG | 1185 |
| PF-208 | S. epidermidis (D)<br>C. jeikeium (A) | DAYHCHLVRSPDAHDLSMRIGFV | 1186 |
| PF-209 | S. epidermidis (C)<br>P. aeruginosa (H)<br>MRSA (I) | NYAVVSHT | 1187 |
| PF-212 | M. luteus (M) | NDSKASN | 1188 |
| PF-215 | M. luteus (T) | ELKITNYNVNTVLYRYYKWGNDLCE | 1189 |
| PF-220 | S. pneumoniae (H) | VDPADDGTRHIRPEDGDPIEIDE | 1190 |
| PF-224 | M. luteus (T) | DYFYITLSQKNTF | 1191 |
| PF-226 | S. epidermidis (C)<br>M. luteus (T) | LMFFSENMDKRDTLSGKFRYFAGSKVI<br>KLMNWLSENGK | 1192 |
| PF-233 | S. epidermidis (C) | DANAMARTTIAIVYILALIALTISYSL | 1193 |
| PF-234 | M. luteus (T) | RTPYILRS | 1194 |
| PF-235 | M. luteus (T) | GIPFSKPHKRQVNYMKSDVLAYIEQNK<br>MAHTA | 1195 |
| PF-249 | M. luteus (R) | INSRYKISF | 1196 |
| PF-250 | M. luteus (T) | SEDIFGRLANEKANGLEELRKIRLKQ | 1197 |
| PF-255 | M. luteus (M) | DHKINESQHNPFRSDSNKQNVDFF | 1198 |

TABLE 5-continued

Illustrative list of novel morphology, biofilm and growth disrupting peptides.

| ID | Organism, effect | Structure/sequence | SEQ ID NO |
|---|---|---|---|
| PF-257 | M. luteus (R) | VWENRKKYLENEIERHNVFLKLGQEVI KGLNALASRGR | 1199 |
| PF-264 | M. luteus (H) | MQSLSNRQSLIASYILMGIFLSFGYPPA SLSKFFCRLSHL | 1200 |
| PF-270 | M. luteus (H) | MYLTPYAWIAVGSIFAFSVTTIKIGDQN DEKQKSHKNDVHKR | 1201 |
| PF-271 | M. luteus (T) | AAQPQTT SP | 1202 |
| PF-273 | S. epidermidis (C) | LVGALLIFVALIYMVLKGNADKN | 1203 |
| PF-274 | M. luteus (M) | SIQEAEKIIKNDPFYIHDVADYDFMWF EPSKSLEEIKEFV | 1204 |
| PF-276 | M. luteus (M) | LDLALSTNSLNLEGFSF | 1205 |
| PF-278 | S. epidermidis (I) M. luteus (R) C. albicans (B) | LSLATFAKIFMTRSNWSLKRFNRL | 1206 |
| PF-283 | S. epidermidis (H) B. subtilis (H) | MIRIRSPTKKKLNRNSISDWKSNTSGRF FY | 1207 |
| PF-289 | B. subtilis (C) | MGRHLWNPSYFVATVSENTEEQIRKY RKNK | 1208 |
| PF-290 | S. epidermidis (C) | MVHDMTNGTLIIVKH | 1209 |
| PF-292 | S. epidermidis (C) B. subtilis (C) | SFVSTTVRLIFEESKRYKF | 1210 |
| PF-293 | S. epidermidis (C) | YDPLK | 1211 |
| PF-294 | S. epidermidis (C) | DFLVNFLWFKGELNWGKKRYK | 1212 |
| PF-296 | S. epidermidis (C) B. subtilis (C) | GAFGMPSIKTNTICGEKGKFISACDAW LSNLK | 1213 |
| PF-297 | S. epidermidis (C) B. subtilis (C) | ISKGIDDIVYVINKILSIGNIFKIIKRK | 1214 |
| PF-301 | S. epidermidis (C) B. subtilis (C) | GIVLIGLKLIPLLANVLN | 1215 |
| PF-303 | B. subtilis (C) | EYPWSWISEPWPWDKSFYK | 1216 |
| PF-305 | B. subtilis (C) | MREWICPSCNETHDRDINASINILKEGL RLITIQNK | 1217 |
| PF-306 | B. subtilis (C) | GCILPHKKDNYNYIMSKFQDLVKITSKK | 1218 |
| PF-307 | S. epidermidis (T) B. subtilis (H) C. albicans (B) | MKRRCNWCGKLFYLEEKSKEAYCC KECRKKAKKVKK | 1219 |
| PF-310 | S. epidermidis (C) | GVALIGTILVPLLSGLFG | 1220 |
| PF-313 | S. epidermidis (C) | YITSHKNARAIIKKFERDEILEEVITHYL NRK | 1221 |
| PF-318 | S. epidermidis (C) B. subtilis (C) | MGRHLWNPSYFVATVSENTEEQIRKYI NNQKKQVK | 1222 |
| PF-319 | S. epidermidis (C) B. subtilis (C) | SIGSMIGMYSFRHKTKHIKFTFGIPFILF LQFLLVYFYILK | 1223 |
| PF-322 | S. epidermidis (C) B. subtilis (H) | GIVLIGLKLIPLLANVLR | 1224 |
| PF-335 | S. epidermidis (C) B. subtilis (C) | AAYPIEDWSDWYEDFFIMLSNI | 1225 |

TABLE 5-continued

Illustrative list of novel morphology, biofilm and growth disrupting peptides.

| ID | Organism, effect | Structure/sequence | SEQ ID NO |
|---|---|---|---|
| PF-339 | S. epidermidis (C)<br>B. subtilis (C) | KKIDILINKYMYLSK | 1226 |
| PF-342 | S. epidermidis (C)<br>B. subtilis (C) | AFSGVYKTLIVYTRRK | 1227 |
| PF-344 | E. coli (A) | DERLPEAKAIRNFNGSVMVLGR | 1228 |
| PF-347 | S. epidermidis (C)<br>E. coli (C)<br>MRSA (C)<br>E. faecalis (C) | GIFTGVTVVVSLKHC | 1229 |
| PF-349 | S. epidermidis (C)<br>E. coli (C)<br>MRSA (C)<br>E. faecalis (C) | MPKSCHVPVLCDFFFLVIIKFLALFKTIQS | 1230 |
| PF-350 | S. epidermidis (C)<br>E. coli (C)<br>MRSA (C) | LAVILRAIVY | 1231 |
| PF-354 | MRSA (H) | FTFSKCRASNGRGFGTLWL | 1232 |
| PF-355 | S. epidermidis (C)<br>E. coli (C)<br>P. aeruginosa (A)<br>MRSA (A)<br>S. pneumoniae (D)<br>E. faecalis (D)<br>C. jejuni (D) | WIAIGLLLYFSLKNQ | 1233 |
| PF-356 | S. epidermidis (S)<br>P. aeruginosa (A)<br>MRSA (C)<br>S. pneumoniae (R)<br>E. faecalis (R)<br>C. jejuni (D) | VSIKIGAIVIGMIGLMELLTE | 1234 |
| PF-357 | S. epidermidis (M)<br>M. luteus (C)<br>MRSA (M)<br>S. pneumoniae (M) | MLTIIIGFIFWTMTLMLGYLIGEREGRKHE | 1235 |
| PF-360 | S. epidermidis (S)<br>E. coli (C)<br>MRSA (H) | MEQKVKVIFVPRSKPDNQLKTFVSAVLFKA | 1236 |
| PF-362 | E. coli (C)<br>MRSA (C) | NIERILKEKVWMIRCVE | 1237 |
| PF-363 | S. epidermidis (S)<br>E. coli (C)<br>MRSA (H)<br>S. pneumoniae (R)<br>E. faecalis (D)<br>C. jejuni (D) | SMLSVTVMCLMHASVAANQAMEKKV | 1238 |
| PF-366 | S. epidermidis (R)<br>E. coli (C)<br>P. aeruginosa (A)<br>MRSA (D)<br>S. pneumoniae (C)<br>E. faecalis (C)<br>C. jejuni (D) | ALCSVIKAIELGIINVHLQ | 1239 |
| PF-369 | S. epidermidis (S)<br>E. coli (R)<br>MRSA (H)<br>E. faecalis (C) | MSEAVNLLRGARYSQRYAKNQVPYEVIIEK | 1240 |

TABLE 5-continued

Illustrative list of novel morphology, biofilm and growth disrupting peptides.

| ID | Organism, effect | Structure/sequence | SEQ ID NO |
|---|---|---|---|
| PF-370 | S. epidermidis (C)<br>E. coli (R)<br>MRSA (C) | VIFLHKESGNLKEIFY | 1241 |
| PF-373 | S. epidermidis (M)<br>MRSA (M) | HFYLLFER | 1242 |
| PF-374 | S. epidermidis (C)<br>E. coli (C)<br>MRSA (M)<br>E. faecalis (C) | HLFFVKGMFILCQKNQINDE | 1243 |
| PF-375 | S. epidermidis (C)<br>E. coli (C)<br>MRSA (C)<br>E. faecalis (C) | MDSAKAQTMRTDWLAVSCLVASAYL<br>RSMLA | 1244 |
| PF-376 | S. epidermidis (C)<br>E. coli (C)<br>MRSA (C)<br>E. faecalis (C) | MTVFEALMLAIAFATLIVKISNKNDKK | 1245 |
| PF-378 | S. epidermidis (M)<br>MRSA (M) | ESAKSNLNFLMQEEWALFLLL | 1246 |
| PF-379 | S. epidermidis (C)<br>E. coli (C)<br>MRSA (C)<br>E. faecalis (C) | VFVVLFIIYLASKLLTKLFPIKK | 1247 |
| PF-380 | S. epidermidis (C)<br>E. coli (C)<br>P. aeruginosa (A)<br>MRSA (D)<br>S. pneumoniae (D)<br>E. faecalis (C)<br>C. jejuni (D) | KKIIPLITLFVVTLVG | 1248 |
| PF-381 | S. epidermidis (C)<br>E. coli (R)<br>MRSA (C)<br>E. faecalis (C) | QGANPCQQVGFTVNDPDCRLAKTV | 1249 |
| PF-382 | MRSA (M) | KYKCSWCKRVYTLRKDHKTAR | 1250 |
| PF-383 | S. epidermidis (C)<br>E. coli (R) | WSEIEINTKQSN | 1251 |
| PF-385 | E. coli (A) | MIKKSILKIKYYVPVLISLTLILSA | 1252 |
| PF-386 | S. epidermidis (C)<br>E. coli (C)<br>MRSA (C)<br>E. faecalis (C) | FTLTLITTIVAILNYKDKKK | 1253 |
| PF-387 | S. epidermidis (C)<br>E. coli (M)<br>MRSA (C)<br>E. faecalis (C) | GAVGIAFFAGNMKQDKRIADRQNKKS<br>EKK | 1254 |
| PF-389 | S. epidermidis (R)<br>MRSA (C)<br>S. pneumoniae (D)<br>E. faecalis (R)<br>C. jejuni (R) | GLQFKEIAEEFHITTTALQQWHKDNGY<br>PIYNKNNRK | 1255 |
| PF-390 | S. epidermidis (D)<br>E. coli (C)<br>MRSA (D)<br>S. pneumoniae (D)<br>E. faecalis (D)<br>C. jejuni (D) | VVAYVITQVGAIRF | 1256 |

TABLE 5-continued

Illustrative list of novel morphology, biofilm and growth disrupting peptides.

| ID | Organism, effect | Structure/sequence | SEQ ID NO |
|---|---|---|---|
| PF-392 | MRSA (S)<br>E. faecalis (A)<br>C. jejuni (A) | DPAGCNDIVRKYCK | 1257 |
| PF-393 | S. epidermidis (R)<br>MRSA (C)<br>S. pneumoniae (R)<br>E. faecalis (A)<br>C. jejuni (R) | DLVQSILSEFKKSG | 1258 |
| PF-394 | MRSA (C)<br>E. faecalis (A) | VLKEECYQKN | 1259 |
| PF-395 | S. epidermidis (C)<br>E. coli (R)<br>MRSA (C) | YCVPLGNMGNMNNKIW | 1260 |
| PF-396 | S. epidermidis (S)<br>E. coli (C)<br>MRSA (C)<br>E. faecalis (C) | LIYTILASLGVLTVLQAILGREPKAVKA | 1261 |
| PF-397 | S. epidermidis (C) | VEDLMEDLNA | 1262 |
| PF-398 | S. epidermidis (C)<br>E. coli (C)<br>MRSA (C)<br>E. faecalis (C) | ILVVLAGILLVVLSYVGISKFKMNC | 1263 |
| PF-399 | S. epidermidis (C)<br>E. coli (C)<br>MRSA (C)<br>E. faecalis (C) | FPIISALLGAIICIAIYSFIVNRKA | 1264 |
| PF-401 | S. epidermidis (C)<br>E. coli (R)<br>MRSA (C)<br>E. faecalis (C) | YWLSRVTTGHSFAFEKPVPLSLTIK | 1265 |
| PF-403 | S. epidermidis (M)<br>E. coli (R)<br>MRSA (M) | LLSTEQLLKYYDGETFDGFQLPSNE | 1266 |
| PF-404 | S. epidermidis (M)<br>MRSA (M) | VLYFQATVV | 1267 |
| PF-405 | MRSA (M) | LVRIEVDDLEEWYERNFI | 1268 |
| PF-406 | S. epidermidis (C)<br>MRSA (M) | YLEMNADYLSNMDIFDELWEKYLENNK | 1269 |
| PF-407 | S. epidermidis (M)<br>MRSA (C)<br>S. pneumoniae (R)<br>E. faecalis (R) | KPKNKKEKTVISYEKLLSMY | 1270 |
| PF-408 | S. epidermidis (M)<br>MRSA (M) | YCVPLGNMGNMNNKIW | 1271 |
| PF-410 | S. epidermidis (C)<br>E. coli (S)<br>MRSA (M)<br>E. faecalis (C) | FALELIALCRNLFIVYFP | 1272 |
| PF-411 | S. epidermidis (C)<br>E. coli (C)<br>P. aeruginosa (A)<br>MRSA (D)<br>S. pneumoniae (D)<br>E. faecalis (D)<br>C. jejuni (D) | WVAVAILLNIALQTQLT | 1273 |

TABLE 5-continued

Illustrative list of novel morphology, biofilm and growth disrupting peptides.

| ID | Organism, effect | Structure/sequence | SEQ ID NO |
|---|---|---|---|
| PF-413 | S. epidermidis (C)<br>E. coli (S)<br>MRSA (C) | TFAGSIKIGVPDLVHVTFNCKR | 1274 |
| PF-414 | S. pneumoniae (H) | LLNKKLE | 1275 |
| PF-415 | S. pneumoniae (D) | MIDVTIGQKSKTGAFNASYSICFSGENFSF | 1276 |
| PF-416 | S. pneumoniae (H) | SKAGLYGKIERSDKRE | 1277 |
| PF-417 | S. epidermidis (M)<br>MRSA (M)<br>S. pneumoniae (M) | DSYFRS | 1278 |
| PF-418 | S. epidermidis (M)<br>E. coli (C)<br>MRSA (D)<br>S. pneumoniae (D)<br>E. faecalis (D)<br>C. jejuni (D) | FFLVHFYIRKRKGKVSIFLNYF | 1279 |
| PF-419 | S. pneumoniae (H) | VVTGKVGSLPQIK | 1280 |
| PF-421 | S. pneumoniae (H) | KHCFEITDKTDVV | 1281 |
| PF-422 | S. epidermidis (R)<br>MRSA (C)<br>S. pneumoniae (C)<br>E. faecalis (R)<br>C. jejuni (R) | MSRKKYENDEKSQKKLKIGRKSDVFYGIID | 1282 |
| PF-423 | S. pneumoniae (H) | AGKKERLLSFREQFLNKNKKK | 1283 |
| PF-424 | S. pneumoniae (H) | IAAFVTSRAFSDTVSPI | 1284 |
| PF-425 | S. epidermidis (D)<br>E. coli (C)<br>P. aeruginosa (A)<br>C. albicans (A)<br>MRSA (D)<br>S. pneumoniae (D)<br>E. faecalis (D)<br>C. jejuni (D) | MMELVLKTIIGPIVVGVVLRIVDKWLNKDK | 1285 |
| PF-426 | S. epidermidis (D)<br>E. coli (C)<br>C. albicans (A)<br>MRSA (D)<br>S. pneumoniae (D)<br>E. faecalis (D)<br>C. jejuni (D) | MLQKYTQMISVTKCIITKNKKTQENVDAYN | 1286 |
| PF-427 | E. coli (C)<br>MRSA (C)<br>S. pneumoniae (R)<br>E. faecalis (C) | YVLEYHGLRATQDVDAFMAL | 1287 |
| PF-428 | S. pneumoniae (H) | ENEESIF | 1288 |
| PF-429 | S. epidermidis (C)<br>MRSA (C)<br>S. pneumoniae (M)<br>E. faecalis (C) | AATLICVGSGIMSSL | 1289 |
| PF-430 | S. epidermidis (M)<br>MRSA (M)<br>S. pneumoniae (M) | AVVCGYLAYTATS | 1290 |
| PF-431 | S. epidermidis (M)<br>MRSA (C)<br>S. pneumoniae (R) | VAYAAICWW | 1291 |

TABLE 5-continued

Illustrative list of novel morphology, biofilm and growth disrupting peptides.

| ID | Organism, effect | Structure/sequence | SEQ ID NO |
|---|---|---|---|
| | E. faecalis (R) | | |
| | C. jejuni (R) | | |
| PF-432 | S. epidermidis (M) | FNGDSEFFLCIAF | 1292 |
| | E. coli (R) | | |
| | P. aeruginosa (A) | | |
| | MRSA (M) | | |
| | S. pneumoniae (D) | | |
| | E. faecalis (D) | | |
| | C. jejuni (D) | | |
| PF-433 | S. pneumoniae (H) | MRKEFHNVLSSGQLLADKRPARDYNRK | 1293 |
| PF-434 | S. pneumoniae (S) | GQLLADKRPARDYNRK | 1294 |
| PF-437 | S. pneumoniae (I) | FQKPFTGEEVEDFQDDDEIPTII | 1295 |
| PF-439 | S. epidermidis (C) | RVLVLKKFHGIMDGNRNVAVFFVGQ | 1296 |
| | E. coli (R) | | |
| | MRSA (M) | | |
| | S. pneumoniae (R) | | |
| | E. faecalis (C) | | |
| PF-440 | S. epidermidis (C) | MFIISPDLFNIAVILYILFFIHDILLLILS | 1297 |
| | E. coli (R) | | |
| | MRSA (C) | | |
| | S. pneumoniae (R) | | |
| | E. faecalis (C) | | |
| PF-442 | MRSA (M) | MQIFYIKTKIFLSFFLFLLIFSQCFYKIEE | 1298 |
| | S. pneumoniae (C) | | |
| PF-443 | E. coli (R) | KLLYFFNYFENLQQVHLLVQL | 1299 |
| | MRSA (C) | | |
| | S. pneumoniae (C) | | |
| PF-444 | S. epidermidis (C) | MAAKLWEEGKMVYASSASMTKRLKL AMSKV | 1300 |
| | E. coli (R) | | |
| | MRSA (C) | | |
| | S. pneumoniae (R) | | |
| | E. faecalis (C) | | |
| PF-445 | S. pneumoniae (M) | ASMTKRLKLAMSKV | 1301 |
| PF-446 | S. pneumoniae (H) | SGNEKV | 1302 |
| PF-447 | S. epidermidis (C) | IDKSRNKDQFSHIFGLYNICSG | 1303 |
| | MRSA (C) | | |
| | S. pneumoniae (C) | | |
| | E. faecalis (C) | | |
| PF-448 | S. pneumoniae (I) | SLQSQLGPCLHDQRH | 1304 |
| PF-449 | S. pneumoniae (H) | MPTTKSKQKGWTNTKKASNTQ | 1305 |
| PF-450 | MRSA (C) | HRNLIILQRTIFI | 1306 |
| | S. pneumoniae (C) | | |
| | E. faecalis (C) | | |
| PF-451 | S. epidermidis (C) | MVNYIIGSYMLYREQNNNEALRKFDIT LAM | 1307 |
| | E. coli (R) | | |
| | MRSA (C) | | |
| | S. pneumoniae (C) | | |
| | E. faecalis (C) | | |
| PF-452 | S. epidermidis (C) | MNNWIKVAQISVTVINEVIDIMKEKQN GGK | 1308 |
| | E. coli (C) | | |
| | MRSA (C) | | |
| | S. pneumoniae (R) | | |
| | E. faecalis (C) | | |
| PF-453 | S. epidermidis (C) | IIQDIAHAFGY | 1309 |
| | E. coli (C) | | |

TABLE 5-continued

Illustrative list of novel morphology, biofilm and growth disrupting peptides.

| ID | Organism, effect | Structure/sequence | SEQ ID NO |
|---|---|---|---|
| | MRSA (C) | | |
| | S. pneumoniae (C) | | |
| PF-454 | S. epidermidis (C) E. coli (R) P. aeruginosa (H) MRSA (C) S. pneumoniae (R) E. faecalis (C) | MSVFVPVTNIFMFIMSPIFNVNLLHFKV YI | 1310 |
| PF-455 | S. pneumoniae (A) | MARNDDDIKKIKGTLGQSPEVYGERK LPYT | 1311 |
| PF-456 | E. faecalis (A) C. jejuni (A) | TCVKPRTIN | 1312 |
| PF-457 | S. pneumoniae (M) | INKYHHIA | 1313 |
| PF-458 | P. aeruginosa (H) MRSA (M) S. pneumoniae (M) | ISLIIFIMLFVVALFKCITNYKHQS | 1314 |
| PF-459 | S. pneumoniae (H) | EKRMSFNENQSHRPLL | 1315 |
| PF-460 | S. epidermidis (C) E. coli (H) MRSA (C) S. pneumoniae (R) E. faecalis (C) | MEHVLPFQNTPPNIVIIYKDFTHLKSITFS | 1316 |
| PF-461 | MRSA (R) S. pneumoniae (R) E. faecalis (A) | MTLAIKNCSVTKCLGFGDFVNDDSDS YFDA | 1317 |
| PF-462 | S. pneumoniae (H) | KNKTDTL | 1318 |
| PF-464 | S. pneumoniae (S) | VDMVNRFLGN | 1319 |
| PF-465 | S. pneumoniae (H) | KPVGKALEEIADGKIEPVVPKEYLG | 1320 |
| PF-466 | S. pneumoniae (H) | VRKSDQ | 1321 |
| PF-467 | S. pneumoniae (H) | YYKDYFKEI | 1322 |
| PF-468 | S. pneumoniae (H) | EDNKDKKDKKDK | 1323 |
| PF-469 | S. epidermidis (D) E. coli (C) MRSA (D) S. pneumoniae (D) E. faecalis (D) C. jejuni (D) | YKVNYNNIDNHFNTLRH | 1324 |
| PF-470 | E. faecalis (A) C. jejuni (A) | PYSDSYATRPHWEQHRAR | 1325 |
| PF-471 | S. epidermidis (C) E. coli (C) P. aeruginosa (A) MRSA (D) S. pneumoniae (D) E. faecalis (C) C. jejuni (D) | MVGKIRGVTPRNDLLNANITGQLNLN YRLI | 1326 |
| PF-472 | MRSA (C) S. pneumoniae (R) E. faecalis (A) C. jejuni (R) | MHISHLLDEVEQTEREKAVNVLENMN GNVI | 1327 |
| PF-473 | S. epidermidis (R) E. coli (C) MRSA (C) S. pneumoniae (H) | MAADIISTIGDLVKWIIDTVNKFKK | 1328 |

TABLE 5-continued

Illustrative list of novel morphology, biofilm and growth disrupting peptides.

| ID | Organism, effect | Structure/sequence | SEQ ID NO |
|---|---|---|---|
| | *E. faecalis* (R)<br>*C. jejuni* (R) | | |
| PF-474 | *S. epidermidis* (C)<br>*E. coli* (C)<br>*P. aeruginosa* (A)<br>*C. albicans* (B)<br>MRSA (D)<br>*S. pneumoniae* (D)<br>*E. faecalis* (C)<br>*C. jejuni* (D) | MHRNLVLVKMEPIPHIMIIANQIGIIIEKA | 1329 |
| PF-475 | *S. epidermidis* (M)<br>*C. albicans* (B)<br>MRSA (S)<br>*S. pneumoniae* (R)<br>*E. faecalis* (R)<br>*C. jejuni* (R) | MREKVRFTQAFKLFWTNYFNFKGRSR<br>RSEY | 1330 |
| PF-476 | *S. pneumoniae* (H) | WADAQYKLCENCSE | 1331 |
| PF-477 | *S. pneumoniae* (H) | HKNKLNIPHIKS | 1332 |
| PF-478 | *S. epidermidis* (C)<br>*E. coli* (C)<br>MRSA (H)<br>*S. pneumoniae* (C) | HLFILKSHLKPFPPPFRYTYD | 1333 |
| PF-479 | *S. pneumoniae* (C) | AYILKRREEKNK | 1334 |
| PF-480 | *S. epidermidis* (C)<br>*E. coli* (R)<br>MRSA (C)<br>*S. pneumoniae* (R)<br>*E. faecalis* (C) | MVEILVNTAISVYIVALYTQWLSTRDN<br>LKA | 1335 |
| PF-482 | *S. pneumoniae* (S) | LVGYVRTSGTVRSYKIN | 1336 |
| PF-484 | *E. faecalis* (A) | HKKDIRKQVFKN | 1337 |
| PF-485 | *S. pneumoniae* (A) | KNSMSRSIALID | 1338 |
| PF-511 | *S. pneumoniae* (H) | VMQSLYVKPPLILVTKLAQQN | 1339 |
| PF-512 | *S. pneumoniae* (H) | SFMPEIQKNTIPTQMK | 1340 |
| PF-513 | *S. pneumoniae* (M) | SNGVGLGVGIGSGIRF-NH2 | 1341 |
| PF-514 | *S. epidermidis* (C)<br>*E. coli* (R)<br>*S. pneumoniae* (M)<br>*E. faecalis* (C) | QRFYKLFYHIDLTNEQALKLFQVK | 1342 |
| PF-515 | *S. pneumoniae* (H) | DKSTQDKDIKQAKLLAQELGL-NH2 | 1343 |
| PF-516 | *S. pneumoniae* (H) | ASKQASKQASKQASKQ | 1344 |
| PF-517 | *S. pneumoniae* (M) | VKPTMTASLISTVC | 1345 |
| PF-518 | *S. epidermidis* (C)<br>*E. coli* (R)<br>MRSA (C)<br>*S. pneumoniae* (M)<br>*E. faecalis* (C) | SFYSKYSRYIDNLAGAIFLFF | 1346 |
| PF-519 | *E. coli* (R)<br>MRSA (C)<br>*S. pneumoniae* (S)<br>*E. faecalis* (C) | YLVYSGVLATAAAF-NH2 | 1347 |
| PF-520 | *S. pneumoniae* (M) | LGLTAGVAYAAQPTNQPTNQPT<br>NQPTNQPTNQPRW-NH2 | 1348 |
| PF-521 | *S. pneumoniae* (H) | CGKLLEQKNFFLKTR | 1349 |

TABLE 5-continued

Illustrative list of novel morphology, biofilm and growth disrupting peptides.

| ID | Organism, effect | Structure/sequence | SEQ ID NO |
|---|---|---|---|
| PF-522 | S. pneumoniae (H) | FELVDWLETNLGKILKSKSA-NH2 | 1350 |
| PF-524 | E. coli (M)<br>MRSA (C)<br>S. pneumoniae (M)<br>E. faecalis (C) | PDAPRTCYHKPILAALSRIVVTDR | 1351 |
| PF-525 | S. pneumoniae (H) | KFSDQIDKGQDALKDKLGDL | 1352 |
| PF-526 | S. epidermidis (C)<br>E. coli (R)<br>C. albicans (C)<br>MRSA (C)<br>S. pneumoniae (R) | VLLLFIFQPFQKQLL-NH2 | 1353 |
| PF-527 | S. epidermidis (M)<br>M. luteus (S)<br>B. subtilis (I)<br>P. aeruginosa (I)<br>C. albicans (B)<br>MRSA (I)<br>S. pneumoniae (H)<br>C. jeikeium (I)<br>C. jejuni (M) | GSVIKKRRKRMAKKKHRKLLKKTRIQ<br>RRRAGK | 1354 |
| PF-528 | S. epidermidis (H)<br>E. coli (H)<br>C. albicans (C)<br>MRSA (H)<br>S. pneumoniae (R) | LVDVVVLIRRHLPKSCS-NH2 | 1355 |
| PF-529 | S. pneumoniae (H) | LSEMERRRLRKRA-NH2 | 1356 |
| PF-530 | S. epidermidis (H)<br>E. coli (R)<br>MRSA (C)<br>S. pneumoniae (R)<br>E. faecalis (C) | SKFKVLRKIIIKEYKGELMLSIQKQR | 1357 |
| PF-531 | S. epidermidis (I)<br>E. coli (M)<br>P. aeruginosa (I)<br>S. pneumoniae (C) | YIQFHLNQQPRPKVKKIKIFL-NH2 | 1358 |
| PF-532 | E. coli (C)<br>MRSA (C)<br>S. pneumoniae (C)<br>E. faecalis (C) | KFIYKYKLSFIIYKILIQTLTMELNK | 1359 |
| PF-533 | S. epidermidis (H)<br>E. coli (R)<br>MRSA (H)<br>S. pneumoniae (C)<br>E. faecalis (C) | KTPNDKIHKTIIIKHIIL | 1360 |
| PF-534 | S. epidermidis (C)<br>E. coli (R)<br>MRSA (C)<br>S. pneumoniae (R)<br>E. faecalis (C) | KYFHLFYHNIIHYSKQHLSLKVDFKN-<br>NH2 | 1361 |
| PF-535 | P. aeruginosa (H)<br>S. pneumoniae (H) | NIKTRKRALKIIKQHQRSK | 1362 |
| PF-536 | S. epidermidis (C)<br>E. coli (R)<br>P. aeruginosa (H)<br>MRSA (C)<br>S. pneumoniae (M)<br>E. faecalis (C) | MEPIPHIMIIANQIGIIIEKA | 1363 |
| PF-537 | S. pneumoniae (C) | LANDYYKKTKKSW | 1364 |

TABLE 5-continued

Illustrative list of novel morphology, biofilm and growth disrupting peptides.

| ID | Organism, effect | Structure/sequence | SEQ ID NO |
|---|---|---|---|
| PF-538 | S. pneumoniae (H) | KNKKQTDILEKVKEILDKKKKTKSVG QKLY | 1365 |
| PF-539 | MRSA (H)<br>S. pneumoniae (A) | SIILTKKKRRKIPLSIDSQIYKYTFKQ | 1366 |
| PF-540 | S. epidermidis (H)<br>E. coli (R)<br>MRSA (H)<br>S. pneumoniae (R) | KSILILIKVIFIGQTTIIL | 1367 |
| PF-541 | E. coli (H)<br>S. pneumoniae (H) | RRNLNSPNIKTRKRALKIIKQHQRSK | 1368 |
| PF-542 | S. pneumoniae (H) | KKDNPSLNDQDKNAVLNLLALAK | 1369 |
| PF-543 | S. mutans (S)<br>S. epidermidis (D)<br>M. luteus (C)<br>E. coli (C)<br>MRSA (D)<br>S. pneumoniae (D) | NILFGIIGFVVAMTAAVIVTAISIAK | 1370 |
| PF-544 | S. epidermidis (D)<br>MRSA (D)<br>S. pneumoniae (M)<br>E. faecalis (R) | FGEKQMRSWWKVHWFHP | 1371 |
| PF-545 | B. subtilis (I)<br>C. albicans (B)<br>E. faecalis (H)<br>C. jeikeium (H) | RESKLIAMADMIRRRI-NH2 | 1372 |
| PF-546 | S. epidermidis (D)<br>E. coli (R)<br>MRSA (D)<br>S. pneumoniae (D)<br>E. faecalis (D)<br>C. jeikeium (D) | PIIAPTIKTQIQ | 1373 |
| PF-547 | S. epidermidis (R)<br>B. subtilis (I)<br>MRSA (M)<br>E. faecalis (R) | WSRVPGHSDTGWKVWHRW-NH2 | 1374 |
| PF-548 | S. epidermidis (M)<br>M. luteus (A)<br>B. subtilis (C)<br>MRSA (M)<br>S. pneumoniae (D)<br>C. jeikeium (R)<br>C. jejuni (D) | ARPIADLIHFNSTTVTASGDVYYGPG | 1375 |
| PF-549 | B. subtilis (D)<br>MRSA (C) | TGIGPIARPIEHGLDS | 1376 |
| PF-550 | B. subtilis (D) | STENGWQEFESYADVGVDPRRYVPL | 1377 |
| PF-551 | MRSA (C) | QVKEKRREIELQFRDAEKKLEASVQAE | 1378 |
| PF-552 | B. subtilis (D) | ELDKADAALGPAKNLAPLDVINRS | 1379 |
| PF-553 | B. subtilis (D)<br>MRSA (M)<br>S. pneumoniae (R)<br>C. jeikeium (R) | LTIVGNALQQKNQKLLLNQKKITSLG | 1380 |
| PF-554 | B. subtilis (D) | AKNFLTRTAEEIGEQAVREGNINGP | 1381 |
| PF-555 | MRSA (M)<br>S. pneumoniae (R)<br>C. jejuni (R) | EAYMRFLDREMEGLTAAYNVKLFTEA IS | 1382 |

TABLE 5-continued

Illustrative list of novel morphology, biofilm and growth disrupting peptides.

| ID | Organism, effect | Structure/sequence | SEQ ID NO |
|---|---|---|---|
| PF-556 | S. epidermidis (A)<br>M. luteus (A)<br>B. subtilis (C)<br>MRSA (M)<br>S. pneumoniae (D)<br>E. faecalis (A)<br>C. jeikeium (D)<br>C. jejuni (R) | SLQIRMNTLTAAKASIEAA | 1383 |
| PF-557 | B. subtilis (D) | AANKAREQAAAEAKRKAEEQAR | 1384 |
| PF-558 | S. epidermidis (M)<br>B. subtilis (D)<br>MRSA (C)<br>S. pneumoniae (R)<br>C. jejuni (H) | ADAPPPLIVRYS | 1385 |
| PF-559 | B. subtilis (C)<br>C. jejuni (A) | SRPGKPGGVSIDVSRDRQDILSNYP | 1386 |
| PF-560 | B. subtilis (D)<br>MRSA (C)<br>S. pneumoniae (R)<br>C. jejuni (A) | FGNPFRGFTLAMEADFKKRK | 1387 |
| PF-561 | B. subtilis (D)<br>MRSA (M) | ESLEADVQAELDTEAAKYPALPASF | 1388 |
| PF-562 | S. epidermidis (A)<br>M. luteus (R)<br>MRSA (M)<br>S. pneumoniae (D)<br>C. jejuni (R) | TPEQWLERSTVVVTGLLNRK | 1389 |
| PF-563 | B. subtilis (D)<br>S. pneumoniae (H)<br>C. jejuni (H) | RPELDNELDVVQNSASLDKLQASYN | 1390 |
| PF-564 | B. subtilis (D)<br>MRSA (C)<br>C. jeikeium (R)<br>C. jejuni (R) | TIILNDQINSLQERLNKLNAETDRR | 1391 |
| PF-565 | B. subtilis (D)<br>MRSA (C) | RAEAEAQRQAEADAKRKAEEAARL | 1392 |
| PF-566 | M. luteus (D)<br>B. subtilis (C)<br>MRSA (M)<br>S. pneumoniae (D)<br>C. jeikeium (C)<br>C. jejuni (D) | EAQQVTQQLGADFNAITTPTATKV | 1393 |
| PF-567 | M. luteus (C)<br>MRSA (D)<br>S. pneumoniae (D)<br>C. jeikeium (C)<br>C. jejuni (D) | QQRVKAVDASLSQVSTQVSGAVASA | 1394 |
| PF-569 | B. subtilis (D) | KSKISEYTEKEFLEFVEDIYTNNK | 1395 |
| PF-571 | B. subtilis (D) | SDLLYYPNENREDSPAGVVKEVKE | 1396 |
| PF-572 | B. subtilis (D)<br>S. pneumoniae (R) | WRASKGLPGFKAG | 1397 |
| PF-573 | S. pneumoniae (C) | EKKLIVKLIDSIGKSHEEIVGAG | 1398 |
| PF-574 | B. subtilis (D) | LVKSGKLESPYEHSEHLTLSQEKGLE | 1399 |
| PF-575 | P. aeruginosa (A)<br>S. pneumoniae (A) | LNFRAENKILEKIHISLIDTVEGSA | 1400 |

TABLE 5-continued

Illustrative list of novel morphology, biofilm and growth disrupting peptides.

| ID | Organism, effect | Structure/sequence | SEQ ID NO |
|---|---|---|---|
| | C. jeikeium (A)<br>C. jejuni (R) | | |
| PF-576 | S. epidermidis (A)<br>E. coli (A)<br>MRSA (R)<br>S. pneumoniae (C)<br>C. jejuni (C) | AYSGELPEPLVRKMSKEQVRSVMGK | 1401 |
| PF-577 | S. epidermidis (A)<br>E. coli (A)<br>P. aeruginosa (A)<br>MRSA (M)<br>S. pneumoniae (R)<br>E. faecalis (A)<br>C. jejuni (R) | PFETRESFRVPVIGILGGWDYFMHP | 1402 |
| PF-578 | S. mutans (D)<br>S. epidermidis (D)<br>M. luteus (C)<br>P. mirabilis (C)<br>E. coli (C)<br>MRSA (C)<br>S. pneumoniae (D) | QKANLRIGFTYTSDSNVCNLTFALLGSK | 1403 |
| PF-580 | S. epidermidis (M)<br>M. luteus (C)<br>MRSA (M)<br>S. pneumoniae (C) | EILNNNQVIKELTMKYKTQFESNLGG<br>WTARARR | 1404 |
| PF-581 | MRSA (A)<br>S. pneumoniae (A)<br>E. faecalis (A)<br>C. jejuni (A) | WTARARR | 1405 |
| PF-582 | E. faecalis (A) | NLKTIEKECPFCNNKMDIKLKD | 1406 |
| PF-583 | S. mutans (F)<br>S. epidermidis (I)<br>MRSA (I)<br>S. pneumoniae (D) | KFQGEFTNIGQSYIVSASHMSTSLNTGK | 1407 |
| PF-584 | S. epidermidis (C)<br>E. coli (C)<br>MRSA (D)<br>S. pneumoniae (D)<br>E. faecalis (D)<br>C. jejuni (D) | SYIKNLSNQKFLIAF | 1408 |
| PF-585 | S. epidermidis (S)<br>MRSA (S)<br>S. pneumoniae (R)<br>E. faecalis (A)<br>C. jejuni (R) | DYNHLLNVVQDWVNTN | 1409 |
| PF-586 | S. epidermidis (C)<br>E. coli (C)<br>MRSA (D)<br>S. pneumoniae (D)<br>E. faecalis (D)<br>C. jejuni (D) | FFNQANYFFKEF | 1410 |
| PF-587 | S. pneumoniae (C) | ASGKYQSYLLNVYVDSKKDRLDIFDK<br>LKAKAKFVL | 1411 |
| PF-588 | E. faecalis (A) | ESVEAIKAKAIK | 1412 |
| PF-589 | MRSA (M)<br>S. pneumoniae (C) | APLRIDEIRNSNVIDEVLDCAPKKQEHF<br>FVVPKIIE | 1413 |
| PF-590 | C. jejuni (R) | YYQAKLFPLL | 1414 |

TABLE 5-continued

Illustrative list of novel morphology, biofilm and growth disrupting peptides.

| ID | Organism, effect | Structure/sequence | SEQ ID NO |
|---|---|---|---|
| PF-591 | S. pneumoniae (R)<br>E. faecalis (A)<br>C. jejuni (C) | DLLKSLLGQDGAKNDEIIEFIKIIMEK | 1415 |
| PF-592 | S. epidermidis (M)<br>E. coli (C)<br>MRSA (D)<br>S. pneumoniae (D)<br>E. faecalis (D)<br>C. jejuni (S) | IMKNYKYFKLFIVKYALF | 1416 |
| PF-593 | E. faecalis (A) | MEISTLKKEKLHVKDELSQYLANYKK | 1417 |
| PF-594 | E. faecalis (C) | IVSAIV | 1418 |
| PF-595 | S. epidermidis (C)<br>E. coli (C)<br>MRSA (D)<br>S. pneumoniae (R)<br>E. faecalis (D)<br>C. jejuni (D) | LQNKIYELLYIKERSKLCS | 1419 |
| PF-596 | S. epidermidis (D)<br>E. coli (C)<br>MRSA (D)<br>S. pneumoniae (D)<br>E. faecalis (D)<br>C. jejuni (D) | SKMWDKILTILILILELIRELIKL | 1420 |
| PF-597 | E. faecalis (A) | DEIKVSDEEIEKFIKENNL | 1421 |
| PF-598 | S. epidermidis (R)<br>E. coli (C)<br>MRSA (D)<br>S. pneumoniae (R)<br>E. faecalis (R)<br>C. jejuni (R) | MKFMLEVRNKAISAYKEITRTQI | 1422 |
| PF-599 | S. epidermidis (M)<br>MRSA (C)<br>S. pneumoniae (R)<br>E. faecalis (A)<br>C. jejuni (R) | LFEIFKPKH | 1423 |
| PF-600 | S. mutans (S)<br>S. epidermidis (C)<br>M. luteus (C)<br>E. coli (H)<br>MRSA (M)<br>S. pneumoniae (R) | TKKIELKRFVDAFVKKSYENYILEREL<br>KKLIKAINEELPTK | 1424 |
| PF-601 | E. faecalis (A)<br>C. jejuni (A) | YRVTVKALE | 1425 |
| PF-602 | E. faecalis (A) | LEKEKKEYIEKLFKTK | 1426 |
| PF-603 | S. epidermidis (D)<br>M. luteus (A)<br>E. coli (M)<br>MRSA (M)<br>S. pneumoniae (C) | IDKLKKMNLQKLSYEVRISQDGKSIYA<br>RIK | 1427 |
| PF-604 | E. faecalis (A) | LMEQVEV | 1428 |
| PF-605 | S. epidermidis (R)<br>E. coli (C)<br>P. aeruginosa (A)<br>C. albicans (B)<br>MRSA (C)<br>S. pneumoniae (D)<br>E. faecalis (R)<br>C. jejuni (R) | HYRWNTQWWKY | 1429 |

TABLE 5-continued

Illustrative list of novel morphology, biofilm and growth disrupting peptides.

| ID | Organism, effect | Structure/sequence | SEQ ID NO |
|---|---|---|---|
| PF-606 | S. mutans (I)<br>S. epidermidis (I)<br>C. albicans (B)<br>MRSA (I)<br>S. pneumoniae (H) | FESKILNASKELDKEKKVNTALSFNSH<br>QDFAKAYQNGKI | 1430 |
| PF-607 | S. epidermidis (M)<br>MRSA (S)<br>S. pneumoniae (R)<br>E. faecalis (A)<br>C. jejuni (R) | YIESDPRKFDYIFGAIRDH | 1431 |
| PF-609 | MRSA (C)<br>S. pneumoniae (R)<br>E. faecalis (A)<br>C. jejuni (R) | TEIKLDNNEYLVLNLDDILGILK | 1432 |
| PF-610 | S. epidermidis (C)<br>E. coli (C)<br>MRSA (D)<br>S. pneumoniae (D)<br>E. faecalis (D)<br>C. jejuni (D) | VFLKLKTSKIDLASIIFYP | 1433 |
| PF-612 | S. mutans (F)<br>S. epidermidis (C)<br>M. luteus (A)<br>P. mirabilis (C)<br>E. coli (C)<br>MRSA (C)<br>S. pneumoniae (C) | GTTLKYGLERQLKIDIHPEITIINLNGGA<br>DEFAKL | 1434 |
| PF-613 | S. epidermidis (R)<br>MRSA (C)<br>E. faecalis (A) | ADEFAKL | 1435 |
| PF-614 | S. epidermidis (M)<br>S. pneumoniae (R)<br>E. faecalis (A)<br>C. jejuni (R) | GLDIYA | 1436 |
| PF-615 | S. epidermidis (D)<br>E. coli (C)<br>MRSA (D)<br>S. pneumoniae (D)<br>E. faecalis (D)<br>C. jejuni (D) | FLNRFIFYIFTVKTKSALIKNLFLD | 1437 |
| PF-616 | S. epidermidis (R)<br>E. faecalis (A) | IVFVVTKEKK | 1438 |
| PF-617 | C. albicans (H)<br>S. pneumoniae (I)<br>E. faecalis (H) | PMNAAEPE | 1439 |
| PF-618 | S. pneumoniae (I)<br>E. faecalis (H) | KLNTLNKKDNPSLNDQDKNAVLNLLA<br>LAK | 1440 |
| PF-619 | S. epidermidis (M)<br>E. coli (C)<br>MRSA (M)<br>S. pneumoniae (C) | WSRVPGHSDTGWKVWHRW | 1441 |
| PF-621 | S. pneumoniae (I)<br>E. faecalis (H) | PPSSFLV | 1442 |
| PF-622 | S. epidermidis (D)<br>MRSA (D)<br>S. pneumoniae (M)<br>E. faecalis (D)<br>C. jeikeium (D) | TREDVFSVRLINNIVNKQA | 1443 |

TABLE 5-continued

Illustrative list of novel morphology, biofilm and growth disrupting peptides.

| ID | Organism, effect | Structure/sequence | SEQ ID NO |
|---|---|---|---|
| PF-623 | S. epidermidis (M)<br>MRSA (D)<br>S. pneumoniae (D)<br>E. faecalis (D)<br>C. jeikeium (R) | VLFAVYLGALDWLFSWLTQKM | 1444 |
| PF-624 | S. mutans (D)<br>S. epidermidis (D)<br>M. luteus (C)<br>P. mirabilis (C)<br>E. coli (C)<br>MRSA (C)<br>S. pneumoniae (D) | VFLLDSYCFVKINL | 1445 |
| PF-625 | S. pneumoniae (H) | SDSTNNARTRKKARDVTTKDIDK | 1446 |
| PF-626 | S. pneumoniae (H) | KYDFDDFEPEEA | 1447 |
| PF-627 | S. epidermidis (H)<br>C. albicans (B)<br>MRSA (R)<br>S. pneumoniae (I)<br>E. faecalis (H) | INDLLSYFTLHEK | 1448 |
| PF-629 | S. epidermidis (C)<br>MRSA (D)<br>S. pneumoniae (M)<br>E. faecalis (R)<br>C. jeikeium (R) | GLAAIATVFALY | 1449 |
| PF-630 | MRSA (M) | IPATPIIHS | 1450 |
| PF-631 | S. pneumoniae (I)<br>E. faecalis (H) | LIIYFSKTGNTARATRQI | 1451 |
| PF-632 | S. epidermidis (D)<br>B. subtilis (H)<br>C. albicans (B)<br>MRSA (D)<br>S. pneumoniae (M)<br>E. faecalis (D)<br>C. jeikeium (D) | TTIQGVASLEKHGFRYTIIYPTRI | 1452 |
| PF-634 | S. mutans (D)<br>S. epidermidis (D)<br>M. luteus (C)<br>P. mirabilis (C)<br>E. coli (C)<br>MRSA (D)<br>S. pneumoniae (D) | MPKARPVNHNKKKSKITIKSNFTLFYM<br>FNP | 1453 |
| PF-635 | S. epidermidis (M)<br>C. albicans (B)<br>MRSA (D)<br>S. pneumoniae (D)<br>E. faecalis (D)<br>C. jeikeium (D) | MNAHGHSLIFQKMIVHAFAFFSKQKN<br>YLYF | 1454 |
| PF-636 | B. subtilis (H)<br>C. albicans (B)<br>S. pneumoniae (H)<br>E. faecalis (H) | LVRLA | 1455 |
| PF-637 | S. epidermidis (M)<br>MRSA (M)<br>S. pneumoniae (M)<br>E. faecalis (D)<br>C. jeikeium (D) | SRIKQDARSVRKYDRIGIFFYSFKSA | 1456 |
| PF-638 | S. epidermidis (R)<br>MRSA (M)<br>S. pneumoniae (I)<br>E. faecalis (H) | TFILPK | 1457 |

TABLE 5-continued

Illustrative list of novel morphology, biofilm and growth disrupting peptides.

| ID | Organism, effect | Structure/sequence | SEQ ID NO |
|---|---|---|---|
| PF-639 | C. albicans (B)<br>MRSA (R)<br>S. pneumoniae (I)<br>E. faecalis (H) | QATQIKSWIDRLLVSED | 1458 |
| PF-640 | C. albicans (B)<br>S. pneumoniae (I)<br>E. faecalis (H) | MGDINRNF | 1459 |
| PF-642 | MRSA (M) | FTTPMIGIPAGLLGGSYYLKRREEKGK | 1460 |
| PF-643 | MRSA (C)<br>S. pneumoniae (R)<br>E. faecalis (R) | VRCRL | 1461 |
| PF-644 | S. pneumoniae (H) | TSGLIIGENGLNGL | 1462 |
| PF-645 | C. albicans (B)<br>S. pneumoniae (I) | SNSVQQG | 1463 |
| PF-646 | C. albicans (B)<br>S. pneumoniae (H) | APASPGRRPG | 1464 |
| PF-647 | C. albicans (B)<br>S. pneumoniae (R) | GTFLGQKCAAATAS | 1465 |
| PF-649 | E. faecalis (R) | CPRYPFVDVGPAGPWRARWRVGS | 1466 |
| PF-651 | S. pneumoniae (H) | PRWPTGAGRHR | 1467 |
| PF-652 | S. pneumoniae (A) | FLAPARPDLQAQRQALAQ | 1468 |
| PF-653 | S. pneumoniae (H) | QSVHPLPAETPVADVI | 1469 |
| PF-654 | C. albicans (B)<br>MRSA (R)<br>S. pneumoniae (A) | LSGRLAGRR | 1470 |
| PF-655 | S. epidermidis (R)<br>B. subtilis (H)<br>MRSA (M)<br>S. pneumoniae (H) | DAPCFDDQFGDLKCQMC | 1471 |
| PF-656 | MRSA (R) | RGMFVPFHDVDCVQ | 1472 |
| PF-657 | S. epidermidis (C)<br>MRSA (D)<br>S. pneumoniae (H)<br>E. faecalis (D)<br>C. jeikeium (D) | YVANYTITQFGRDFDDRLAVAIHFA | 1473 |
| PF-658 | MRSA (R)<br>S. pneumoniae (H) | PTTPPPTTPPEIPTGGTVIST | 1474 |
| PF-659 | S. epidermidis (M)<br>B. subtilis (H)<br>MRSA (R)<br>S. pneumoniae (C) | TVIST | 1475 |
| PF-660 | S. pneumoniae (H) | TDPQATAAPRRRTSPR | 1476 |
| PF-661 | MRSA (R) | PDEDIRRRAILPPAGPCRPMSPE | 1477 |
| PF-662 | S. pneumoniae (A) | GKQSRAHGPVASRREFRRKSG | 1478 |
| PF-663 | S. pneumoniae (A) | ATLIPRKA | 1479 |
| PF-664 | S. epidermidis (M)<br>MRSA (R)<br>S. pneumoniae (M)<br>E. faecalis (R) | DQLCVEYPARVSTG | 1480 |
| PF-665 | S. pneumoniae (H) | VLRVATAVGEVPTGL | 1481 |

TABLE 5-continued

Illustrative list of novel morphology, biofilm and growth disrupting peptides.

| ID | Organism, effect | Structure/sequence | SEQ ID NO |
|---|---|---|---|
| PF-666 | S. pneumoniae (A) | PNRRSRPR | 1482 |
| PF-667 | S. epidermidis (R)<br>MRSA (R)<br>S. pneumoniae (R)<br>E. faecalis (R) | PAHQRLRIDQRLVADRDMVQDYES | 1483 |
| PF-668 | S. epidermidis (M)<br>B. subtilis (A)<br>C. albicans (A)<br>MRSA (R)<br>S. pneumoniae (M)<br>E. faecalis (D)<br>C. jeikeium (D) | TNAESMALAFRGRVHMSVNIAGLT | 1484 |
| PF-670 | B. subtilis (H)<br>S. pneumoniae (H) | TVIVAPMHSGV | 1485 |
| PF-672 | S. epidermidis (I)<br>B. subtilis (I)<br>C. albicans (I)<br>MRSA (I)<br>S. pneumoniae (I)<br>E. faecalis (I)<br>C. jeikeium (R) | MRFGSLALVAYDSAIKHSWPRPSSVRRLRM | 1486 |
| PF-675 | S. pneumoniae (C)<br>E. faecalis (R) | EIIPISPTRRCEMHTMSSAEYRGL | 1487 |
| PF-677 | S. epidermidis (R)<br>MRSA (D)<br>S. pneumoniae (D)<br>E. faecalis (R) | TCRGAGMH | 1488 |
| PF-680 | MRSA (R) | ADPHPTTGI | 1489 |
| PF-681 | S. epidermidis (M)<br>MRSA (M)<br>S. pneumoniae (M)<br>E. faecalis (R)<br>C. jeikeium (R) | TALTTVGVSGARLITYCVGVEDI | 1490 |
| PF-682 | S. pneumoniae (A) | RRGKSEQGLSRR | 1491 |
| PF-683 | S. epidermidis (R)<br>MRSA (R)<br>S. pneumoniae (H) | LWPVA | 1492 |
| PF-684 | C. albicans (B)<br>S. pneumoniae (C)<br>E. faecalis (A) | RKLSLASGFALWRRSLV | 1493 |
| PF-685 | S. epidermidis (M)<br>MRSA (M)<br>S. pneumoniae (M)<br>E. faecalis (R)<br>C. jeikeium (R) | PTLWLACL | 1494 |
| PF-686 | S. epidermidis (H)<br>B. subtilis (I)<br>C. albicans (B)<br>MRSA (M)<br>S. pneumoniae (A)<br>E. faecalis (R) | LAVLMGYIGYRGWSGKRHINRQ | 1495 |
| PF-687 | S. pneumoniae (A) | AKRVLSLAVAPHRRQPVQGT | 1496 |
| PF-688 | S. pneumoniae (A) | ARNHAVIPAG | 1497 |
| PF-690 | S. epidermidis (R)<br>MRSA (R)<br>S. pneumoniae (M)<br>E. faecalis (R) | MIPLAGDPVSSHRTVEFGVLGTYLVSGGSL | 1498 |

TABLE 5-continued

Illustrative list of novel morphology, biofilm and growth disrupting peptides.

| ID | Organism, effect | Structure/sequence | SEQ ID NO |
|---|---|---|---|
| PF-691 | S. pneumoniae (R) | HRTVEFGVLGTYLVSGGSL | 1499 |
| PF-692 | MRSA (R) | GVAREDPLEPDPLAPIIDDSR | 1500 |
| PF-693 | S. pneumoniae (A) | PDPAR | 1501 |
| PF-694 | MRSA (R)<br>S. pneumoniae (A) | DLIRPLYSMSAPSVA | 1502 |
| PF-695 | MRSA (R)<br>S. pneumoniae (C)<br>E. faecalis (R) | ALSVMLGNIPLVVPNANQL | 1503 |
| PF-696 | S. pneumoniae (H) | IRSGISAAYARPLR | 1504 |
| PF-697 | C. albicans (H)<br>S. pneumoniae (H) | RADARAK | 1505 |
| PF-698 | C. albicans (H)<br>S. pneumoniae (A)<br>E. faecalis (A) | SSGRAGVKCRRPTGR | 1506 |
| PF-699 | S. pneumoniae (A) | GRAGVKCRRPTGR | 1507 |
| PF-700 | S. pneumoniae (C) | LNWPFTGR | 1508 |
| PF-702 | S. pneumoniae (H) | LSGRLAGRR | 1509 |
| PF-704 | S. pneumoniae (C) | APAARAAL | 1510 |
| PF-737 | S. pneumoniae (D) | KSSGSSASASSTAGGSSSK | 1511 |
| PF-738 | MRSA (M) | KSGATSAASGAKSGASS | 1512 |
| PF-741 | S. mutans (D)<br>S. epidermidis (C)<br>M. luteus (C)<br>P. mirabilis (C)<br>E. coli (C)<br>MRSA (C)<br>S. pneumoniae (D) | AKREDTVAAQIGANILNLIQ | 1513 |
| PF-744 | S. pneumoniae (H) | LGVGTFVGKVLIKNQQKQKSKKKAQ | 1514 |
| PF-745 | S. mutans (D)<br>M. luteus (C)<br>MRSA (C)<br>S. pneumoniae (C) | ANSQNSLFSNRSSFKSIFDKKSNITTNA TTPNSNIIIN | 1515 |
| PF-746 | S. mutans (D)<br>S. epidermidis (C)<br>M. luteus (C)<br>E. coli (C)<br>P. aeruginosa (A)<br>MRSA (C)<br>S. pneumoniae (C) | FLGNSQYFTRK | 1516 |
| PF-748 | S. pneumoniae (H) | FQGFFDVAVNKWWEEHNKAKLWKN VKGKFLEGEGEEEDDE | 1517 |
| PF-749 | S. pneumoniae (H) | GVNKWWEEHNKAKLWKNVKGKFLE GEGEEEDDE | 1518 |
| PF-752 | S. pneumoniae (C) | LHVIRPRPELSELKFPITKILKVNKQGL KK | 1519 |
| PF-756 | S. pneumoniae (A) | DALLRLA | 1520 |
| PF-757 | S. pneumoniae (H) | PQAISSVQQNA | 1521 |
| PF-760 | S. epidermidis (M)<br>MRSA (M)<br>S. pneumoniae (C) | DHITLDDYEIHDGFNFELYYG | 1522 |

TABLE 5-continued

Illustrative list of novel morphology, biofilm and growth disrupting peptides.

| ID | Organism, effect | Structure/sequence | SEQ ID NO |
|---|---|---|---|
| PF-761 | S. mutans (D)<br>S. epidermidis (C)<br>M. luteus (C)<br>E. coli (C)<br>P. aeruginosa (C)<br>MRSA (D)<br>S. pneumoniae (C) | SKFELVNYASGCSCGADCKCASETECK<br>CASKK | 1523 |
| PF-762 | S. pneumoniae (H) | PAPAPSAPAPAPEQPEQPA | 1524 |
| PF-763 | S. epidermidis (M)<br>M. luteus (C)<br>MRSA (D)<br>S. pneumoniae (C) | GIWMARNYFHRSSIRKVYVESDKEYE<br>RVHPMQKIQYEGNYKSQ | 1525 |
| PF-764 | MRSA (D)<br>S. pneumoniae (H) | GYFEPGKRD | 1526 |
| PF-770 | S. mutans (D)<br>S. epidermidis (D)<br>M. luteus (C)<br>P. mirabilis (C)<br>E. coli (C)<br>MRSA (D)<br>S. pneumoniae (C) | GVGIGFIMMGVVGYAVKLVHIPIRYLIV | 1527 |
| PF-776 | S. mutans (D)<br>S. epidermidis (D)<br>M. luteus (C)<br>E. coli (C)<br>MRSA (D)<br>S. pneumoniae (C) | VSILLYLSATIILPNVLRLLVARAIIVRV | 1528 |
| PF-C052 | P. gingivalis (H) | SRFRNGV | 1529 |
| PF-C055 | F. nucleatum (T)<br>S. mutans (I) | YNLSIYIYFLHTITIAGLITLPFII | 1530 |
| PF-C057 | S. mutans (I) | YFWWYWVQDCIPYKNNEVWLELSNN<br>MK | 1531 |
| PF-C058 | S. mutans (F) | FETGFGDGYYMSLWGLNEKDEVCKV<br>VIPFINPELID | 1532 |
| PF-C061 | F. nucleatum (T)<br>S. mutans (F) | TLNYKKMFFSVIFLLGLNYLICNSPLFF<br>KQIEF | 1533 |
| PF-C062 | F. nucleatum (T)<br>S. mutans (I) | PLARATEVVATLFIICSLLLYLTR | 1534 |
| PF-C064 | F. nucleatum (T) | DEEALEMGANLYAQFAIDFLNSKK | 1535 |
| PF-C065 | F. nucleatum (T) | DEERYSDSYFLKEKVFYLILALFLILFH<br>QKYLYFLEIITI | 1536 |
| PF-C069 | F. nucleatum (T) | NALMLREMQLAKNIKVEVTDVLSNKK<br>YC | 1537 |
| PF-C071 | F. nucleatum (T) | QVIVKIL | 1538 |
| PF-C072 | F. nucleatum (T)<br>P. gingivalis (T)<br>S. mutans (F) | KKMFSLIRKVNWIFFILFIVLDLTNVFP<br>LIRTILFAILSRQ | 1539 |
| PF-C075 | F. nucleatum (T)<br>P. gingivalis (R)<br>S. mutans (F) | KALVISVFAIVFSIIFVKFFYWRDKK | 1540 |
| PF-C084 | F. nucleatum (T)<br>P. gingivalis (R)<br>S. mutans (F) | FFSVIFLFGLNYLICNSPLFNILR | 1541 |
| PF-C085 | S. mutans (F) | KKFKIFVIINWFYHKYIILNFEENF | 1542 |

TABLE 5-continued

Illustrative list of novel morphology, biofilm and growth disrupting peptides.

| ID | Organism, effect | Structure/sequence | SEQ ID NO |
|---|---|---|---|
| PF-C086 | F. nucleatum (T) | ELFFTILSDCNELFLLHLLQQPLFYIKK GK | 1543 |
| PF-C088 | F. nucleatum (H) P. gingivalis (R) S. mutans (I) | DIANNILNSVSERLIIA | 1544 |
| PF-C089 | P. gingivalis (R) | MPKRHYYKLEAKALQFGLPFAYSPIQL LK | 1545 |
| PF-C091 | F. nucleatum (T) | ASNTPRFVRLTLFNFYSKIWNVTHLFLF NNL | 1546 |
| PF-C095 | F. nucleatum (T) | LLALNMNEDTYYFELFFIFDNQNKKW LIFDLKERG | 1547 |
| PF-C098 | F. nucleatum (T) S. mutans (F) | PETKGKVSAFVFGIVVANVIAVVYILY MLREIGIIQ | 1548 |
| PF-C120 | F. nucleatum (T) | ASLSTMTFKVMELKELIILLCGLTMLMI QTEFV | 1549 |
| PF-C131 | F. nucleatum (T) S. mutans (F) | QWIVAKREIRMHIYCHISVIHVIIFFG | 1550 |
| PF-C135 | F. nucleatum (C) S. mutans (F) | KNTHAYLRVLRLSSLILSYQASVYPLF AYLCQQKDY | 1551 |
| PF-C136 | F. nucleatum (C) P. gingivalis (R) | LILSYQASVYPLFAYLCQQKDY | 1552 |
| PF-C137 | F. nucleatum (T) | QRMYWFKRGFETGDFSAGDTFAELK | 1553 |
| PF-C139 | S. mutans (F) | LLASHPERLSLGVFFVYRVLHLLLENT | 1554 |
| PF-C142 | S. mutans (I) | DFPPLSFFRRRFHAYTAPIDNFFGANPF | 1555 |
| PF-C143 | F. nucleatum (C) | VVFGGGDRLV | 1556 |
| PF-C145 | F. nucleatum (C) S. mutans (I) | YGKESDP | 1557 |
| PF-C180 | P. gingivalis (R) S. mutans (S) | TVEELDKAFTWGAAAALAIGVIAINVG LAAGYCYNNNDVF | 1558 |
| PF-C181 | F. nucleatum (T) | KMRAGQVVFIYKLILVLLFYVLQKLFD LKKGCF | 1559 |
| PF-C194 | F. nucleatum (T) P. gingivalis (T) S. mutans (F) | NTNDLLQAFELMGLGMAGVFIVLGILY IVAELLIKIFPVNN | 1560 |
| PF-C214 | F. nucleatum (T) | GGHKQLVIEPLVSQ | 1561 |
| PF-C281 | S. mutans (F) | KKEKLLTAIRLQHRAEIRGYFTIFFLFFRI | 1562 |
| PF-C290 | S. mutans (F) | GNVHPESDFHNLIQFIKTFLYFTIFFKYFL | 1563 |
| PF-C291 | F. nucleatum (T) S. mutans (F) | HPFLTGTGCPLFLIFRLFFVKAYFSFTVF | 1564 |
| PF-C293 | F. nucleatum (T) P. gingivalis (R) S. mutans (F) | IIIILPKIYLVCKTV | 1565 |
| PF-S003 | S. epidermidis (R) M. luteus (R) B. subtilis (A) P. aeruginosa (A) C. albicans (A) MRSA (M) S. pneumoniae (D) | ALALLKQDLLNFEGRGRIITSTYLQFNE GCVP | 1566 |

TABLE 5-continued

Illustrative list of novel morphology, biofilm and growth disrupting peptides.

| ID | Organism, effect | Structure/sequence | SEQ ID NO |
|---|---|---|---|
| | C. jeikeium (D) | | |
| | C. jejuni (D) | | |

Key to Abbreviations:
(A) Peptide aggregates;
(B) Less hyphal formation;
(C) Clumps;
(D) Diffuse clumps and small polyps;
(F) Diffuse growth;
(H) Thin;
(I) Growth inhibition;
(M) Microcolony formation;
(R) Rippled;
(S) Small polyps;
(T) Thick;
(W) Halo formation on top, microlonies on bottom. These data thus indicate peptide-mediated interruption of bacterial biofilm formation processes, cellular metabolism, cellular import/export, nutrient acquisition, quorum sensing and communication, motility, chemotaxis, replication, translation, and/or transcription. Accordingly, without being bound to a particular theory, it is believed that the alteration of one or more of these basic pathways is important to pathogenesis, or the stopping thereof.

In certain embodiments, the amino acid sequence of the antimicrobial peptides comprises or consists of a single amino acid sequence, e.g., as listed above in Tables 4 and/or 5, and/or Table 15, and/or below in Table 14. In certain embodiments the amino acid sequence of the antimicrobial peptides comprises two copies, three copies, four copies, five copies six copies or more of one or more of the amino acid sequences listed in Tables 4, and/or 5, and/or Table 15, and/or Table 14. Thus, compound antimicrobial constructs are contemplated where the construct comprises multiple domains each having antimicrobial activity. The AMP domains comprising such a construct can be the same or different. In certain embodiments the construct comprises at least 2, at least 3, at least 4, at least 5, at least 6, at least 7, or at least 8 different AMP domains each domain comprising a different AMP sequence.

Various AMP domains comprising such a construct can be joined directly to each other or two or more of such domains can be attached to each other via a linker. An illustrative, but non-limiting, list of suitable linkers is provided in Table 16. Thus, in certain embodiments, two or more AMP domains comprising a compound AMP construct are chemically conjugated together.

In certain embodiments the two or more AMP domains comprising the AMP construct are joined by a peptide linker. Where all the AMP domains are attached directly to each other or are joined by peptide linkers, the entire construct can be provided as a single-chain peptide (fusion protein).

In various embodiments, the antimicrobial peptides described herein comprise one or more of the amino acid sequences shown in Tables 4, and/or 5, and/or 15 and/or 14 (and/or the retro, inverso, retroinverso, etc. forms of such sequences). In certain embodiments the peptides range in length up to about 100 amino acids in length, preferably up to about 80, about 70, about 60, or about 51 amino acids in length. In certain embodiments the peptides range in length from about 8 amino acids up to about 100 amino acids 80 amino acids, 60 amino acids or about 51 amino acids in length. In certain embodiments the peptides range in length from about 8 up to about 50, 40, 30, 20, 15, 15, 13, or 12 amino acids in length.

As shown in Tables 4, and/or 5, and/or 15 and/or 14, the various amino acid sequences described herein are effective against particular microorganisms. The range of activity of the peptides or compositions comprising such peptides can be increased by including amino acid sequences effective against different microorganisms either as separate components and/or as multiple domains within a single construct.

TABLE 6

Illustrative target microorganisms and peptides effective against that target.

Gram Positive Bacteria:

| | |
|---|---|
| A. naeslundii | PF-531, PF-527, PF-672, PF-545, PF-168, PF-448, PF-525, PF-529, PF-148 |
| B. subtilis | PF-002, PF-005, PF-006, PF-040, PF-053, PF-056, PF-061, PF-063, PF-067, PF-068, PF-069, PF-070, PF-071, PF-145, PF-148, PF-171, PF-175, PF-283, PF-289, PF-292, PF-296, PF-297, PF-301, PF-303, PF-305, PF-306, PF-307, PF-318, PF-319, PF-322, PF-335, PF-339, PF-342, PF-497, PF-499, PF-527, PF-531, PF-545, PF-547, PF-548, PF-549, PF-550, PF-552, PF-553, PF-554, PF-556, PF-557, PF-558, PF-559, PF-560, PF-561, PF-563, PF-564, PF-565, PF-566, PF-569, PF-571, PF-572, PF-574, PF-632, PF-636, PF-655, PF-659, PF-668, PF-670, PF-672, PF-686, PF-998, PF-2003 |
| C. difficile | PF-522, PF-531, PF-538 |
| C. jeikeium | PF-001, PF-003, PF-004, PF-101, PF-011, PF-012, PF-013, PF-021, PF-022, PF-025, PF-028, PF-030, PF-032, PF-033, PF-036, PF-037, PF-040, PF-042, PF-043, PF-046, PF-048, PF-052, PF-053, PF-056, PF-057, PF- |

TABLE 6-continued

Illustrative target microorganisms and peptides effective against that target.

| | |
|---|---|
| | 063, PF-065, PF-067, PF-068, PF-073, PF-075, PF-076, PF-099, PF-124, PF-127, PF-129, PF-133, PF-135, PF-137, PF-139, PF-140, PF-145, PF-148, PF-164, PF-173, PF-176, PF-186, PF-188, PF-190, PF-191, PF-196, PF-199, PF-203, PF-204, PF-208, PF-527, PF-531, PF-545, PF-546, PF-548, PF-553, PF-556, PF-564, PF-566, PF-567, PF-575, PF-622, PF-523, PF-629, PF-632, PF-635, PF-637, PF-657, PF-668, PF-672, PF-681, PF-685, PF-S003 |
| E. faecalis | PF-007, PF-053, PF-057, PF-068, PF-347, PF-349, PF-355, PF-356, PF-363, PF-366, PF-369, PF-374, PF-375, PF-376, PF-379, PF-380, PF-381, PF-386, PF-387, PF-389, PF-390, PF-392, PF-393, PF-394, PF-396, PF-398, PF-399, PF-401, PF-407, PF-410, PF-411, PF-418, PF-422, PF-425, PF-426, PF-427, PF-429, PF-431, PF-432, PF-439, PF-440, PF-444, PF-447, PF-450, PF-451, PF-452, PF-454, PF-456, PF-460, PF-461, PF-469, PF-470, PF-471, PF-472, PF-473, PF-474, PF-475, PF-480, PF-484, PF-514, PF-518, PF-519, PF-524, PF-530, PF-532, PF-533, PF-534, PF-536, PF-544, PF-545, PF-546, PF-547, PF-556, PF-577, PF-581, PF-582, PF-584, PF-585, PF-586, PF-588, PF-591, PF-592, PF-593, PF-594, PF-595, PF-596, PF-597, PF-598, PF-599, PF-601, PF-602, PF-604, PF-605, PF-607, PF-609, PF-610, PF-613, PF-614, PF-615, PF-616, PF-617, PF-618, PF-621, PF-622, PF-623, PF-627, PF-629, PF-631, PF-632, PF-635, PF-636, PF-637, PF-638, PF-639, PF-640, PF-643, PF-649, PF-657, PF-664, PF-667, PF-668, PF-672, PF-675, PF-677, PF-681, PF-684, PF-685, PF-686, PF-690, PF-695, PF-698 |
| M. luteus | PF-001, PF-003, PF-004, PF-006, PF-007, PF-010, PF-012, PF-013, PF-020, PF-021, PF-022, PF-025, PF-030, PF-036, PF-037, PF-040, PF-042, PF-043, PF-051, PF-052, PF-053, PF-056, PF-057, PF-063, PF-067, PF-068, PF-071, PF-073, PF-075, PF-076, PF-125, PF-127, PF-137, PF-139, PF-140, PF-145, PF-148, PF-171, PF-175, PF-176, PF-199, PF-204, PF-212, PF-215, PF-224, PF-226, PF-234, PF-235, PF-249, PF-250, PF-255, PF-257, PF-264, PF-270, PF-271, PF-274, PF-276, PF-278, PF-357, PF-527, PF-543, PF-548, PF-556, PF-562, PF-566, PF-567, PF-578, PF-580, PF-600, PF-603, PF-612, PF-624, PF-634, PF-741, PF-745, PF-746, PF-761, PF-763, PF-770, PF-776, PF-S003 |
| MRSA | PF-001, PF-003, PF-004, PF-006, PF-007, PF-010, PF-011, PF-012, PF-013, PF-015, PF-017, PF-019, PF-020, PF-021, PF-022, PF-023, PF-024, PF-025, PF-026, PF-027, PF-028, PF-029, PF-030, PF-031, PF-033, PF-035, PF-036, PF-037, PF-040, PF-041, PF-042, PF-043, PF-045, PF-046, PF-048, PF-049, PF-051, PF-052, PF-053, PF-056, PF-057, PF-058, PF-063, PF-064, PF-065, PF-066, PF-067, PF-068, PF-071, PF-073, PF-074, PF-075, PF-076, PF-140, PF-145, PF-148, PF-149, PF-156, PF-168, PF-171, PF-178, PF-191, PF-209, PF-347, PF-349, PF-350, PF-354, PF-355, PF-356, PF-357, PF-360, PF-362, PF-366, PF-369, PF-370, PF-373, PF-374, PF-375, PF-376, PF-378, PF-379, PF-380, PF-381, PF-382, PF-386, PF-387, PF-389, PF-390, PF-392, PF-393, PF-394, PF-395, PF-396, PF-398, PF-399, PF-401, PF-403, PF-404, PF-405, PF-406, PF-407, PF-408, PF-410, PF-411, PF-413, PF-417, PF-418, PF-422, PF-425, PF-426, PF-427, PF-429, PF-430, PF-431, PF-432, PF-439, PF-440, PF-442, PF-443, PF-444, PF-447, PF-450, PF-451, PF-452, PF-453, PF-454, PF-458, PF-460, PF-461, PF-469, PF-471, PF-472, PF-473, PF-474, PF-475, PF-478, PF-480, PF-518, PF-519, PF-524, PF-526, PF-527, PF-528, PF-530, PF-532, PF-533, PF-534, PF-536, PF-539, PF-540, PF-543, PF-544, PF-545, PF-546, PF-547, PF-548, PF-549, PF-551, PF-553, PF-555, PF-556, PF-558, PF-560, PF-561, PF-562, PF-564, PF-565, PF-566, PF-567, PF-576, PF-577, PF-578, PF-580, PF-581, PF-583, PF-584, PF-585, PF-586, PF-589, PF-592, PF-595, PF-596, PF-598, PF-599, PF-600, PF-603, PF-605, PF-606, PF-607, PF-609, PF-610, PF-612, PF-613, PF-615, PF-619, PF-622, PF-623, PF-624, PF-627, PF-629, PF-630, PF-632, PF-634, PF-635, PF-637, PF-638, PF-639, PF-652, PF-643, PF-654, PF-655, PF-656, PF-657, PF-658, PF-659, PF-661, PF-664, PF-667, PF-778, PF-672, PF-677, PF-680, PF-683, PF-685, PF-686, PF-690, PF-692, PF-694, PF-695, PF-738, PF-741, PF-745, PF-746, PF-760, PF-761, PF-763, PF-764, PF-770, PF-776, PF-S003 |
| S. epidermidis | PF-001, PF-003, PF-004, PF-006, PF-007, PF-009, PF-010, PF-012, PF-013, PF-020, PF-021, PF-022, PF-024, PF-025, PF-027, PF-028, PF-030, PF-032, PF-033, PF-034, PF-036, PF-037, PF-040, PF-041, PF-042, PF-043, PF-046, PF-048, PF-051, PF-052, PF-953, PF-956, PF-957, PF-961, PF-963, PF-964, PF-965, PF-967, PF-968, PF-971, PF-073, PF-074, PF-075, PF-076, PF-099, PF-123, PF-124, PF-125, PF-127, PF-128, PF-129, PF-137, PF-139, PF-140, PF-145, PF-148, PF-153, PF-157, PF-171, PF-173, PF-176, PF-178, PF-180, PF-186, PF-190, PF-191, PF-192, PF-196, PF-199, PF-203, PF-204, PF-208, PF-209, PF-226, PF-233, PF-273, PF-278, PF-283, PF-290, PF-292, PF-293, PF-294, PF-296, PF-297, PF-301, PF-307, PF-310, PF-313, PF-318, PF-319, PF-322, PF-335, PF-339, PF-342, PF-347, PF-349, PF-350, PF-355, PF-356, PF-357, PF-360, PF-363, PF-366, PF-369, PF-370, PF-373, PF-374, PF-375, PF-376, PF-378, PF-379, PF-380, PF-381, PF-383, PF-386, PF-387, PF-389, PF-390, PF-393, PF-395, PF-396, PF-397, PF-398, PF-399, PF-401, PF-403, PF-404, PF-406, PF-407, PF-408, PF-410, PF-411, PF-413, PF-417, PF-418, PF-422, |

TABLE 6-continued

Illustrative target microorganisms and peptides effective against that target.

|  |  |
|---|---|
|  | PF-425, PF-246, PF-249, PF-430, PF-431, PF-432, PF-439, PF-440, PF-444, PF-447, PF-451, PF-452, PF-453, PF-454, PF-460, PF-469, PF-471, PF-473, PF-474, PF-475, PF-478, PF-480, PF-514, PF-518, PF-526, PF-527, PF-528, PF-530, PF-531, PF-533, PF-534, PF-536, PF-540, PF-543, PF-544, PF-546, PF-547, PF-548, PF-556, PF-558, PF-562, PF-576, PF-577, PF-578, PF-580, PF-583, PF-584, PF-585, PF-586, PF-592, PF-595, PF-596, PF-598, PF-599, PF-600, PF-603, PF-605, PF-606, PF-607, PF-610, PF-612, PF-613, PF-614, PF-615, PF-616, PF-619, PF-622, PF-623, PF-624, PF-627, PF-632, PF-634, PF-635, PF-637, PF-638, PF-655, PF-657, PF-659, PF-664, PF-667, PF-778, PF-672, PF-677, PF-681, PF-683, PF-685, PF-686, PF-690, PF-741, PF-746, PF-760, PF-761, PF-763, PF-770, PF-776, PF-S003 |
| *S. mutans* | G-1, G-2, G-4, G-8, PF-020, PF-040, PF-051, PF-531, PF-543, PF-547, PF-578, PF-583, PF-600, PF-606, PF-612, PF-624, PF-634, PF-741, PF-745, PF-746, PF-761, PF-770, PF-776, PF-C055, PF-C057, PF-C058, PF-C061, PF-C062, PF-C072, PF-C075, PF-C084, PF-C085, PF-C088, PF-C098, PF-C131, PF-C135, PF-C139, PF-C142, PF-C146, PF-C180, PF-C194, PF-C281, PF-C290, PF-C291, PF-C293 |
| *S. pneumoniae* | PF-002, PF-005, PF-006, PF-020, PF-033, PF-040, PF-051, PF-053, PF-056, PF-057, PF-061, PF-063, PF-068, PF-071, PF-073, PF-140, PF-144, PF-145, PF-148, PF-171, PF-175, PF-178, PF-220, PF-355, PF-356, PF-357, PF-363, PF-366, PF-380, PF-389, PF-390, PF-393, PF-407, PF-411, PF-414, PF-415, PF-416, PF-417, PF-418, PF-419, PF-421, PF-422, PF-423, PF-424, PF-425, PF-426, PF-427, PF-428, PF-429, PF-430, PF-431, PF-432, PF-433, PF-434, PF-437, PF-439, PF-440, PF-442, PF-443, PF-444, PF-445, PF-446, PF-447, PF-448, PF-449, PF-450, PF-451, PF-452, PF-453, PF-454, PF-455, PF-457, PF-458, PF-469, PF-460, PF-461, PF-462, PF-464, PF-465, PF-466, PF-467, PF-468, PF-469, PF-471, PF-472, PF-473, PF-474, PF-475, PF-476, PF-477, PF-478, PF-479, PF-480, PF-482, PF-485, PF-511, PF-512, PF-513, PF-514, PF-515, PF-516, PF-517, PF-518, PF-519, PF-520, PF-521, PF-522, PF-523, PF-524, PF-525, PF-526, PF-527, PF-528, PF-529, PF-530, PF-531, PF-532, PF-533, PF-534, PF-535, PF-536, PF-537, PF-538, PF-539, PF-540, PF-541, PF-542, PF-543, PF-544, PF-546, PF-548, PF-553, PF-555, PF-556, PF-558, PF-560, PF-562, PF-563, PF-566, PF-567, PF-572, PF-573, PF-575, PF-576, PF-577, PF-578, PF-580, PF-581, PF-583, PF-585, PF-586, PF-587, PF-589, PF-591, PF-592, PF-595, PF-596, PF-598, PF-599, PF-600, PF-603, PF-605, PF-606, PF-607, PF-609, PF-610, PF-612, PF-614, PF-615, PF-617, PF-618, PF-619, PF-621, PF-622, PF-623, PF-624, PF-625, PF-626, PF-627, PF-629, PF-631, PF-632, PF-634, PF-635, PF-636, PF-637, PF-638, PF-639, PF-640, PF-643, PF-644, PF-645, PF-646, PF-647, PF-651, PF-652, PF-653, PF-654, PF-655, PF-657, PF-658, PF-659, PF-660, PF-662, PF-663, PF-664, PF-665, PF-666, PF-667, PF-668, PF-670, PF-672, PF-675, PF-677, PF-681, PF-682, PF-683, PF-684, PF-685, PF-686, PF-687, PF-688, PF-690, PF-691, PF-693, PF-694, PF-695, PF-696, PF-697, PF-698, PF-699, PF-700, PF-702, PF-704, PF-737, PF-741, PF-744, PF-745, PF-746, PF-748, PF-749, PF-752, PF-756, PF-757, PF-760, PF-761, PF-762, PF-763, PF-764, PF-770, PF-776, PF-S003 |
|  | Gram Negative Bacteria: |
| *A. baumannii* | PF-531, PF-006, PF-538, PF-530 |
| *C. jejuni* | PF-006, PF-008, PF-033, PF-040, PF-053, PF-056, PF-057, PF-059, PF-061, PF-063, PF-067, PF-068, PF-069, PF-071, PF-073, PF-140, PF-145, PF-148, PF-171, PF-175, PF-355, PF-356, PF-363, PF-366, PF-380, PF-389, PF-390, PF-392, PF-393, PF-411, PF-418, PF-422, PF-425, PF-426, PF-431, PF-432, PF-456, PF-469, PF-470, PF-471, PF-472, PF-473, PF-474, PF-475, PF-527, PF-548, PF-555, PF-556, PF-558, PF-559, PF-560, PF-562, PF-563, PF-564, PF-566, PF-567, PF-575, PF-576, PF-577, PF-581, PF-584, PF-585, PF-586, PF-590, PF-591, PF-592, PF-595, PF-596, PF-598, PF-599, PF-601, PF-605, PF-607, PF-609, PF-610, PF-614, PF-615, PF-S003 |
| *E. coli* | PF-007, PF-040, PF-053, PF-057, PF-068, PF-178, PF-344, PF-347, PF-349, PF-350, PF-355, PF-360, PF-362, PF-363, PF-366, PF-369, PF-370, PF-374, PF-375, PF-376, PF-379, PF-380, PF-381, PF-383, PF-385, PF-386, PF-387, PF-390, PF-395, PF-396, PF-398, PF-399, PF-401, PF-403, PF-410, PF-411, PF-413, PF-418, PF-425, PF-426, PF-427, PF-432, PF-439, PF-440, PF-443, PF-444, PF-451, PF-452, PF-453, PF-454, PF-460, PF-469, PF-471, PF-473, PF-474, PF-478, PF-480, PF-514, PF-518, PF-519, PF-524, PF-526, PF-528, PF-530, PF-531, PF-532, PF-533, PF-534, PF-536, PF-540, PF-541, PF-543, PF-546, PF-576, PF-577, PF-578, PF-584, PF-586, PF-592, PF-595, PF-596, PF-598, PF-600, PF-603, PF-605, PF-606, PF-610, PF-612, PF-615, PF-619, PF-624, PF-634, PF-741, PF-746, PF-761, PF-770, PF-776 |
| *F. nucleatum* | PF-C055, PF-C061, PF-C062, PF-C064, PF-C065, PF-C069, PF-C071, PF-C072, PF-C075, PF-C084, PF-C086, PF-C088, PF-C091, PF-C095, PF-C098, PF-C120, PF-C131, PF-C135, PF-C136, PF-C137, PF-C143, PF-C145, PF-C181, PF-C194, PF-C214, PF-C291, PF-C293 |
| *M. xanthus* | G-5, G-6, G-7 |

TABLE 6-continued

Illustrative target microorganisms and peptides effective against that target.

| | |
|---|---|
| P. aeruginosa | PF-053, PF-063, PF-067, PF-128, PF-140, PF-143, PF-168, PF-204, PF-209, PF-355, PF-356, PF-366, PF-380, PF-411, PF-425, PF-432, PF-454, PF-458, PF-471, PF-474, PF-527, PF-531, PF-535, PF-536, PF-575, PF-577, PF-605, PF-746, PF-761, PF-S003 |
| P. gingivalis | PF-C052, PF-C072, PF-C075, PF-C084, PF-C088, PF-C089, PF-C136, PF-C180, PF-C194, C293 |
| P. mirabilis | PF-040, PF-578, PF-612, PF-624, PF-634, PF-741, PF-770 |
| Yeast Fungi: | |
| A. niger | PF-531, PF-527, PF-672, PF-545, PF-168, PF-448, PF-525, PF-529, PF-148 |
| C. albicans | PF-053, PF-056, PF-057, PF-071, PF-140, PF-148, PF-175, PF-278, PF-307, PF-425, PF-426, PF-474, PF-475, PF-526, PF-527, PF-528, PF-545, PF-605, PF-606, PF-617, PF-627, PF-632, PF-635, PF-636, PF-639, PF-640, PF-645, PF-646, PF-647, PF-654, PF-668, PF-672, PF-684, PF-686, PF-697, PF-698, PF-S003 |
| T. rubrum | PF-283, PF-307, PF-527, PF-531, PF-547, PF-672 |

In certain embodiments the activity against a particular microorganism or group of microorganisms can be increased by increasing the number of peptides or peptide domains with activity against that microorganism or group of microorganisms.

Thus, for example, in certain embodiments, a peptide or composition effective to kill or inhibit the growth and/or proliferation of a yeast or fungus can comprise or more peptides and/or one or more peptide domains having sequences selected from the sequences shown in Tables 4, 5, or 6 (e.g., PF-S003, PF-053, PF-056, PF-057, PF-071, PF-140, PF-148, PF-168, PF-175, PF-278, PF-283, PF-307, PF-425, PF-426, PF-448, PF-474, PF-475, PF-525, PF-526, PF-527, PF-528, PF-529, PF-531, PF-545, PF-547, PF-606, PF-617, PF-627, PF-632, PF-635, PF-636, PF-639, PF-640, PF-645, PF-646, PF-647, PF-654, PF-668, PF-672, PF-684, PF-686, PF-697, and PF-69)8. A peptide or composition effective to kill or inhibit the growth and/or proliferation of Aspergillus niger can comprise one or more peptides and/or one or more peptide domains having sequences selected from the group consisting of PF-531, PF-527, PF-672, PF-545, PF-168, PF-448, PF-525, PF-529, and PF-148. A peptide or composition effective to kill or inhibit the growth and/or proliferation of Candida albicans can comprise one or more peptides and/or one or more peptide domains having sequences selected from the group consisting of PF-053, PF-056, PF-057, PF-071, PF-140, PF-148, PF-175, PF-278, PF-307, PF-425, PF-426, PF-474, PF-475, PF-526, PF-527, PF-528, PF-545, PF-605, PF-606, PF-617, PF-627, PF-632, PF-635, PF-636, PF-639, PF-640, PF-645, PF-646, PF-647, PF-654, PF-668, PF-672, PF-684, PF-686, PF-697, PF-698, and PF-S003. A peptide or composition effective to kill or inhibit the growth and/or proliferation of Trichophyton rubrum can comprise one or more peptides and/or one or more peptide domains having sequences selected from the group consisting of PF-283, PF-307, PF-527, PF-531, PF-547, and PF-672.

In certain embodiments a peptide or composition effective to kill or inhibit the growth and/or proliferation of a bacterium can comprise one or more peptides and/or one or more peptide domains comprising or consisting of sequences identified as having activity against a bacterium in Tables 4, 5, or 6.

In certain embodiments a peptide or composition effective to kill or inhibit the growth and/or proliferation of a gram positive bacterium can comprise one or more peptides and/or one or more peptide domains comprising or consisting of sequences identified as having activity against a gram positive bacterium in Tables 4, 5, or 6. In certain embodiments a peptide or composition effective to kill or inhibit the growth and/or proliferation of a gram negative bacterium can comprise one or more peptides and/or one or more peptide domains comprising or consisting of sequences identified as having activity against a gram negative bacterium in Tables 4, 5, or 6.

In certain embodiments a peptide or composition effective to kill or inhibit the growth and/or proliferation of A. naeslundii can comprise one or more peptides and/or one or more peptide domains comprising or consisting of sequences identified as having activity against A. Naeslundii in Tables 4, 5, or 6 (e.g., from the group consisting of PF-531, PF-527, PF-672, PF-545, PF-168, PF-448, PF-525, PF-529, and PF-148).

In certain embodiments a peptide or composition effective to kill or inhibit the growth and/or proliferation of B. subtilis can comprise one or more peptides and/or one or more peptide domains comprising or consisting of sequences identified as having activity against B. subtilis in Tables 4, 5, or 6 (e.g., from the group consisting of PF-002, PF-005, PF-006, PF-040, PF-053, PF-056, PF-061, PF-063, PF-067, PF-068, PF-069, PF-070, PF-071, PF-145, PF-148, PF-171, PF-175, PF-283, PF-289, PF-292, PF-296, PF-297, PF-301, PF-303, PF-305, PF-306, PF-307, PF-318, PF-319, PF-322, PF-335, PF-339, PF-342, PF-497, PF-499, PF-527, PF-531, PF-545, PF-547, PF-548, PF-549, PF-550, PF-552, PF-553, PF-554, PF-556, PF-557, PF-558, PF-559, PF-560, PF-561, PF-563, PF-564, PF-565, PF-566, PF-569, PF-571, PF-572, PF-574, PF-632, PF-636, PF-655, PF-659, PF-668, PF-670, PF-672, PF-686, PF-998, and PF-2003).

In certain embodiments a peptide or composition effective to kill or inhibit the growth and/or proliferation of C. difficile can comprise one or more peptides and/or one or more peptide domains comprising or consisting of sequences identified as having activity against C. difficile in Tables 4, 5, or 6 (e.g., from the group consisting of PF-522, PF-531, and PF-538).

In certain embodiments a peptide or composition effective to kill or inhibit the growth and/or proliferation of C. jeikeium can comprise one or more peptides and/or one or more peptide domains comprising or consisting of sequences identified as having activity against C. jeikeium in Tables 4, 5, or 6 (e.g., from the group consisting of PF-001, PF-003, PF-004, PF-101, PF-011, PF-012, PF-013, PF-021, PF-022, PF-025, PF-028, PF-030, PF-032, PF-033, PF-036, PF-037, PF-040, PF-042, PF-043, PF-046, PF-048, PF-052, PF-053, PF-056, PF-057, PF-063, PF-065, PF-067, PF-068, PF-073, PF-075, PF-076, PF-099, PF-124, PF-127, PF-129, PF-133, PF-135, PF-137, PF-139, PF-140, PF-145, PF-148, PF-164, PF-173, PF-176, PF-186, PF-188, PF-190, PF-191, PF-196, PF-199, PF-203, PF-204, PF-208, PF-527, PF-531, PF-545, PF-546, PF-548, PF-553, PF-556, PF-564, PF-566, PF-567, PF-575, PF-622, PF-523, PF-629, PF-632, PF-635, PF-637, PF-657, PF-668, PF-672, PF-681, PF-685, and PF-S003).

In certain embodiments a peptide or composition effective to kill or inhibit the growth and/or proliferation of *E. faecalis* can comprise one or more peptides and/or one or more peptide domains comprising or consisting of sequences identified as having activity against *E. faecalis* in Tables 4, 5, or 6 (e.g., from the group consisting of PF-007, PF-053, PF-057, PF-068, PF-347, PF-349, PF-355, PF-356, PF-363, PF-366, PF-369, PF-374, PF-375, PF-376, PF-379, PF-380, PF-381, PF-386, PF-387, PF-389, PF-390, PF-392, PF-393, PF-394, PF-396, PF-398, PF-399, PF-401, PF-407, PF-410, PF-411, PF-418, PF-422, PF-425, PF-426, PF-427, PF-429, PF-431, PF-432, PF-439, PF-440, PF-444, PF-447, PF-450, PF-451, PF-452, PF-454, PF-456, PF-460, PF-461, PF-469, PF-470, PF-471, PF-472, PF-473, PF-474, PF-475, PF-480, PF-484, PF-514, PF-518, PF-519, PF-524, PF-530, PF-532, PF-533, PF-534, PF-536, PF-544, PF-545, PF-546, PF-547, PF-556, PF-577, PF-581, PF-582, PF-584, PF-585, PF-586, PF-588, PF-591, PF-592, PF-593, PF-594, PF-595, PF-596, PF-597, PF-598, PF-599, PF-601, PF-602, PF-604, PF-605, PF-607, PF-609, PF-610, PF-613, PF-614, PF-615, PF-616, PF-617, PF-618, PF-621, PF-622, PF-623, PF-627, PF-629, PF-631, PF-632, PF-635, PF-636, PF-637, PF-638, PF-639, PF-640, PF-643, PF-649, PF-657, PF-664, PF-667, PF-668, PF-672, PF-675, PF-677, PF-681, PF-684, PF-685, PF-686, PF-690, PF-695, and PF-698).

In certain embodiments a peptide or composition effective to kill or inhibit the growth and/or proliferation of *M. luteus* can comprise one or more peptides and/or one or more peptide domains comprising or consisting of sequences identified as having activity against *M. luteus* in Tables 4, 5, or 6 (e.g., from the group consisting of PF-001, PF-003, PF-004, PF-006, PF-007, PF-010, PF-012, PF-013, PF-020, PF-021, PF-022, PF-025, PF-030, PF-036, PF-037, PF-040, PF-042, PF-043, PF-051, PF-052, PF-053, PF-056, PF-057, PF-063, PF-067, PF-068, PF-071, PF-073, PF-075, PF-076, PF-125, PF-127, PF-137, PF-139, PF-140, PF-145, PF-148, PF-171, PF-175, PF-176, PF-199, PF-204, PF-212, PF-215, PF-224, PF-226, PF-234, PF-235, PF-249, PF-250, PF-255, PF-257, PF-264, PF-270, PF-271, PF-274, PF-276, PF-278, PF-357, PF-527, PF-543, PF-548, PF-556, PF-562, PF-566, PF-567, PF-578, PF-580, PF-600, PF-603, PF-612, PF-624, PF-634, PF-741, PF-745, PF-746, PF-761, PF-763, PF-770, PF-776, and PF-S003).

In certain embodiments a peptide or composition effective to kill or inhibit the growth and/or proliferation of MRSA can comprise one or more peptides and/or one or more peptide domains comprising or consisting of sequences identified as having activity against MRSA in Tables 4, 5, or 6 (e.g., from the group consisting of PF-001, PF-003, PF-004, PF-006, PF-007, PF-010, PF-011, PF-012, PF-013, PF-015, PF-017, PF-019, PF-020, PF-021, PF-022, PF-023, PF-024, PF-025, PF-026, PF-027, PF-028, PF-029, PF-030, PF-031, PF-033, PF-035, PF-036, PF-037, PF-040, PF-041, PF-042, PF-043, PF-045, PF-046, PF-048, PF-049, PF-051, PF-052, PF-053, PF-056, PF-057, PF-058, PF-063, PF-064, PF-065, PF-066, PF-067, PF-068, PF-071, PF-073, PF-074, PF-075, PF-076, PF-140, PF-145, PF-148, PF-149, PF-156, PF-168, PF-171, PF-178, PF-191, PF-209, PF-347, PF-349, PF-350, PF-354, PF-355, PF-356, PF-357, PF-360, PF-362, PF-366, PF-369, PF-370, PF-373, PF-374, PF-375, PF-376, PF-378, PF-379, PF-380, PF-381, PF-382, PF-386, PF-387, PF-389, PF-390, PF-392, PF-393, PF-394, PF-395, PF-396, PF-398, PF-399, PF-401, PF-403, PF-404, PF-405, PF-406, PF-407, PF-408, PF-410, PF-411, PF-413, PF-417, PF-418, PF-422, PF-425, PF-426, PF-427, PF-429, PF-430, PF-431, PF-432, PF-439, PF-440, PF-442, PF-443, PF-444, PF-447, PF-450, PF-451, PF-452, PF-453, PF-454, PF-458, PF-460, PF-461, PF-469, PF-471, PF-472, PF-473, PF-474, PF-475, PF-478, PF-480, PF-518, PF-519, PF-524, PF-526, PF-527, PF-528, PF-530, PF-532, PF-533, PF-534, PF-536, PF-539, PF-540, PF-543, PF-544, PF-545, PF-546, PF-547, PF-548, PF-549, PF-551, PF-553, PF-555, PF-556, PF-558, PF-560, PF-561, PF-562, PF-564, PF-565, PF-566, PF-567, PF-576, PF-577, PF-578, PF-580, PF-581, PF-583, PF-584, PF-585, PF-586, PF-589, PF-592, PF-595, PF-596, PF-598, PF-599, PF-600, PF-603, PF-605, PF-606, PF-607, PF-609, PF-610, PF-612, PF-613, PF-615, PF-619, PF-622, PF-623, PF-624, PF-627, PF-629, PF-630, PF-632, PF-634, PF-635, PF-637, PF-638, PF-639, PF-652, PF-643, PF-654, PF-655, PF-656, PF-657, PF-658, PF-659, PF-661, PF-664, PF-667, PF-778, PF-672, PF-677, PF-680, PF-683, PF-685, PF-686, PF-690, PF-692, PF-694, PF-695, PF-738, PF-741, PF-745, PF-746, PF-760, PF-761, PF-763, PF-764, PF-770, PF-776, and PF-S003).

In certain embodiments a peptide or composition effective to kill or inhibit the growth and/or proliferation of *S. epidermidis* can comprise one or more peptides and/or one or more peptide domains comprising or consisting of sequences identified as having activity against of *S. epidermidis* in Tables 4, 5, or 6 (e.g., from the group consisting of PF-001, PF-003, PF-004, PF-006, PF-007, PF-009, PF-010, PF-012, PF-013, PF-020, PF-021, PF-022, PF-024, PF-025, PF-027, PF-028, PF-030, PF-032, PF-033, PF-034, PF-036, PF-037, PF-040, PF-041, PF-042, PF-043, PF-046, PF-048, PF-051, PF-052, PF-953, PF-956, PF-957, PF-961, PF-963, PF-964, PF-965, PF-967, PF-968, PF-971, PF-073, PF-074, PF-075, PF-076, PF-099, PF-123, PF-124, PF-125, PF-127, PF-128, PF-129, PF-137, PF-139, PF-140, PF-145, PF-148, PF-153, PF-157, PF-171, PF-173, PF-176, PF-178, PF-180, PF-186, PF-190, PF-191, PF-192, PF-196, PF-199, PF-203, PF-204, PF-208, PF-209, PF-226, PF-233, PF-273, PF-278, PF-283, PF-290, PF-292, PF-293, PF-294, PF-296, PF-297, PF-301, PF-307, PF-310, PF-313, PF-318, PF-319, PF-322, PF-335, PF-339, PF-342, PF-347, PF-349, PF-350, PF-355, PF-356, PF-357, PF-360, PF-363, PF-366, PF-369, PF-370, PF-373, PF-374, PF-375, PF-376, PF-378, PF-379, PF-380, PF-381, PF-383, PF-386, PF-387, PF-389, PF-390, PF-393, PF-395, PF-396, PF-397, PF-398, PF-399, PF-401, PF-403, PF-404, PF-406, PF-407, PF-408, PF-410, PF-411, PF-413, PF-417, PF-418, PF-422, PF-425, PF-246, PF-249, PF-430, PF-431, PF-432, PF-439, PF-440, PF-444, PF-447, PF-451, PF-452, PF-453, PF-454, PF-460, PF-469, PF-471, PF-473, PF-474, PF-475, PF-478, PF-480, PF-514, PF-518, PF-526, PF-527, PF-528, PF-530, PF-531, PF-533, PF-534, PF-536, PF-540, PF-543, PF-544, PF-546, PF-547, PF-548, PF-556, PF-558, PF-562, PF-576, PF-577, PF-578, PF-580, PF-583, PF-584, PF-585, PF-586, PF-592, PF-595, PF-596, PF-598, PF-599, PF-600, PF-603, PF-605, PF-606, PF-607, PF-610, PF-612, PF-613, PF-614, PF-615, PF-616, PF-619, PF-622, PF-623, PF-624, PF-627, PF-632, PF-634, PF-635, PF-637, PF-638, PF-655, PF-657, PF-659, PF-664, PF-667, PF-778, PF-672, PF-677, PF-681, PF-683, PF-685, PF-686, PF-690, PF-741, PF-746, PF-760, PF-761, PF-763, PF-770, PF-776, and PF-S003).

In certain embodiments a peptide or composition effective to kill or inhibit the growth and/or proliferation of *S. mutans* can comprise one or more peptides and/or one or more peptide domains comprising or consisting of sequences identified as having activity against *S. mutans* in Tables 4, 5, or 6 (e.g., from the group consisting of G-1, G-2, G-4, G-8, PF-020, PF-040, PF-051, PF-531, PF-543, PF-547, PF-578, PF-583, PF-600, PF-606, PF-612, PF-624, PF-634, PF-741, PF-745, PF-746, PF-761, PF-770, PF-776, PF-0055, PF-0057, PF-0058, PF-0061, PF-0062, PF-0072, PF-0075, PF-0084, PF-0085, PF-0088, PF-0098, PF-C131, PF-C135, PF-C139, PF-C142, PF-C146, PF-C180, PF-C194, PF-C281, PF-C290, PF-C291, PF-C293

In certain embodiments a peptide or composition effective to kill or inhibit the growth and/or proliferation of *S. pneumoniae* can comprise one or more peptides and/or one or more peptide domains comprising or consisting of sequences identified as having activity against *S. pneumoniae* in Tables 4, 5, or 6 (e.g., from the group consisting of PF-002, PF-005, PF-006, PF-020, PF-033, PF-040, PF-051, PF-053, PF-056, PF-057, PF-061, PF-063, PF-068, PF-071, PF-073, PF-140, PF-144, PF-145, PF-148, PF-171, PF-175, PF-178, PF-220, PF-355, PF-356, PF-357, PF-363, PF-366, PF-380, PF-389, PF-390, PF-393, PF-407, PF-411, PF-414, PF-415, PF-416, PF-417, PF-418, PF-419, PF-421, PF-422, PF-423, PF-424, PF-425, PF-426, PF-427, PF-428, PF-429, PF-430, PF-431, PF-432, PF-433, PF-434, PF-437, PF-439, PF-440, PF-442, PF-443, PF-444, PF-445, PF-446, PF-447, PF-448, PF-449, PF-450, PF-451, PF-452, PF-453, PF-454, PF-455, PF-457, PF-458, PF-469, PF-460, PF-461, PF-462, PF-464, PF-465, PF-466, PF-467, PF-468, PF-469, PF-471, PF-472, PF-473, PF-474, PF-475, PF-476, PF-477, PF-478, PF-479, PF-480, PF-482, PF-485, PF-511, PF-512, PF-513, PF-514, PF-515, PF-516, PF-517, PF-518, PF-519, PF-520, PF-521, PF-522, PF-523, PF-524, PF-525, PF-526, PF-527, PF-528, PF-529, PF-530, PF-531, PF-532, PF-533, PF-534, PF-535, PF-536, PF-537, PF-538, PF-539, PF-540, PF-541, PF-542, PF-543, PF-544, PF-546, PF-548, PF-553, PF-555, PF-556, PF-558, PF-560, PF-562, PF-563, PF-566, PF-567, PF-572, PF-573, PF-575, PF-576, PF-577, PF-578, PF-580, PF-581, PF-583, PF-585, PF-585, PF-586, PF-587, PF-589, PF-591, PF-592, PF-595, PF-596, PF-598, PF-599, PF-600, PF-603, PF-605, PF-606, PF-607, PF-609, PF-610, PF-612, PF-614, PF-615, PF-617, PF-618, PF-619, PF-621, PF-622, PF-623, PF-624, PF-625, PF-626, PF-627, PF-629, PF-631, PF-632, PF-634, PF-635, PF-636, PF-637, PF-638, PF-639, PF-640, PF-643, PF-644, PF-645, PF-646, PF-647, PF-651, PF-652, PF-653, PF-654, PF-655, PF-657, PF-658, PF-659, PF-660, PF-662, PF-663, PF-664, PF-665, PF-666, PF-667, PF-668, PF-670, PF-672, PF-675, PF-677, PF-681, PF-682, PF-683, PF-684, PF-685, PF-686, PF-687, PF-688, PF-690, PF-691, PF-693, PF-694, PF-695, PF-696, PF-697, PF-698, PF-699, PF-700, PF-702, PF-704, PF-737, PF-741, PF-744, PF-745, PF-746, PF-748, PF-749, PF-752, PF-756, PF-757, PF-760, PF-761, PF-762, PF-763, PF-764, PF-770, PF-776, and PF-S003).

In certain embodiments a peptide or composition effective to kill or inhibit the growth and/or proliferation of *A. baumannii* can comprise one or more peptides and/or one or more peptide domains comprising or consisting of sequences identified as having activity against *A. baumannii* in Tables 4, 5, or 6 (e.g., from the group consisting of PF-531, PF-006, PF-538, and PF-530).

In certain embodiments a peptide or composition effective to kill or inhibit the growth and/or proliferation of *C. jejuni* can comprise one or more peptides and/or one or more peptide domains comprising or consisting of sequences identified as having activity against *C. jejuni* in Tables 4, 5, or 6 (e.g., from the group consisting of PF-006, PF-008, PF-033, PF-040, PF-053, PF-056, PF-057, PF-059, PF-061, PF-063, PF-067, PF-068, PF-069, PF-071, PF-073, PF-140, PF-145, PF-148, PF-171, PF-175, PF-355, PF-356, PF-363, PF-366, PF-380, PF-389, PF-390, PF-392, PF-393, PF-411, PF-418, PF-422, PF-425, PF-426, PF-431, PF-432, PF-456, PF-469, PF-470, PF-471, PF-472, PF-473, PF-474, PF-475, PF-527, PF-548, PF-555, PF-556, PF-558, PF-559, PF-560, PF-562, PF-563, PF-564, PF-566, PF-567, PF-575, PF-576, PF-577, PF-581, PF-584, PF-585, PF-586, PF-590, PF-591, PF-592, PF-595, PF-596, PF-598, PF-599, PF-601, PF-605, PF-607, PF-609, PF-610, PF-614, PF-615, and PF-S003).

In certain embodiments a peptide or composition effective to kill or inhibit the growth and/or proliferation of *E. coli* can comprise one or more peptides and/or one or more peptide domains comprising or consisting of sequences identified as having activity against *E. coli* in Tables 4, 5, or 6 (e.g., from the group consisting of PF-007, PF-040, PF-053, PF-057, PF-068, PF-178, PF-344, PF-347, PF-349, PF-350, PF-355, PF-360, PF-362, PF-363, PF-366, PF-369, PF-370, PF-374, PF-375, PF-376, PF-379, PF-380, PF-381, PF-383, PF-385, PF-386, PF-387, PF-390, PF-395, PF-396, PF-398, PF-399, PF-401, PF-403, PF-410, PF-411, PF-413, PF-418, PF-425, PF-426, PF-427, PF-432, PF-439, PF-440, PF-443, PF-444, PF-451, PF-452, PF-453, PF-454, PF-460, PF-469, PF-471, PF-473, PF-474, PF-478, PF-480, PF-514, PF-518, PF-519, PF-524, PF-526, PF-528, PF-530, PF-531, PF-532, PF-533, PF-534, PF-536, PF-540, PF-541, PF-543, PF-546, PF-576, PF-577, PF-578, PF-584, PF-586, PF-592, PF-595, PF-596, PF-598, PF-600, PF-603, PF-605, PF-606, PF-610, PF-612, PF-615, PF-619, PF-624, PF-634, PF-741, PF-746, PF-761, PF-770, and PF-776).

In certain embodiments a peptide or composition effective to kill or inhibit the growth and/or proliferation of *F. nucleatum* can comprise one or more peptides and/or one or more peptide domains comprising or consisting of sequences identified as having activity against *F. nucleatum* in Tables 4, 5, or 6 (e.g., from the group consisting of PF-C055, PF-0061, PF-0062, PF-0064, PF-0065, PF-0069, PF-0071, PF-0072, PF-0075, PF-C084, PF-0086, PF-0088, PF-0091, PF-0095, PF-0098, PF-C120, PF-C131, PF-C135, PF-C136, PF-C137, PF-C143, PF-C145, PF-C181, PF-C194, PF-C214, PF-C291, and PF-C293).

In certain embodiments a peptide or composition effective to kill or inhibit the growth and/or proliferation of *M. Xanthus* can comprise one or more peptides and/or one or more peptide domains comprising or consisting of sequences identified as having activity against *M. Xanthus* in Tables 4, 5, or 6 (e.g., from the group consisting of G-5, G-6, and G-7).

In certain embodiments a peptide or composition effective to kill or inhibit the growth and/or proliferation of *P. aeruginosa* can comprise one or more peptides and/or one or more peptide domains comprising or consisting of sequences identified as having activity against *P. aeruginosa* in Tables 4, 5, or 6 (e.g., from the group consisting of PF-053, PF-063, PF-067, PF-128, PF-140, PF-143, PF-168, PF-204, PF-209, PF-355, PF-356, PF-366, PF-380, PF-411, PF-425, PF-432, PF-454, PF-458, PF-471, PF-474, PF-527, PF-531, PF-535, PF-536, PF-575, PF-577, PF-605, PF-746, PF-761, and PF-S003).

In certain embodiments a peptide or composition effective to kill or inhibit the growth and/or proliferation of *P. gingivalis* can comprise one or more peptides and/or one or more peptide domains comprising or consisting of sequences identified as having activity against *P. gingivalis* in Tables 4, 5, or 6 (e.g., from the group consisting of PF-C052, PF-0072, PF-0075, PF-C084, PF-0088, PF-0089, PF-C136, PF-C180, PF-C194, and C293).

In certain embodiments a peptide or composition effective to kill or inhibit the growth and/or proliferation of *P. mirabilis* can comprise one or more peptides and/or one or more peptide domains comprising or consisting of sequences identified as having activity against *P. mirabilis* in Tables 4, 5, or 6 (e.g., from the group consisting of PF-040, PF-578, PF-612, PF-624, PF-634, PF-741, and PF-770).

It was also a surprising discovery that a number of novel antimicrobial peptides are characterized by the presence of particular amino acid motifs. Such motifs include KIF, FIK, KIH, HIK, and KIV, as illustrated in Table 7.

TABLE 7

Antimicrobial peptides characterized by particular motifs.

| Motif | Omnibus # | Sequence | SEQ ID NO |
|---|---|---|---|
| KIF | PF-278 | LSLATFAKIFMTRSNWSLKRFNRL | 1567 |
|  | PF-C059 | QKIIDMSKFLFSLILFIMIVVIYIGKSIGGYSAIVSS IMLELDTVLYNKKIFFIYK | 1568 |
|  | PF-C073 | FESLLPQATKKIVNNKGSKINKIF | 1569 |
|  | PF-C085 | KKFKIFVIINWFYHKYIILNFEENF | 1570 |
|  | PF-531 | YIQFHLNQQPRPKVKKIKIFL | 1571 |
|  | PF-C194 | NTNDLLQAFELMGLGMAGVFIVLGILYIVAELLI KIFPVNN | 1572 |
|  | PF-C201 | IFKLFEEHLLYLLDAFYYSKIFRRLKQGLYRRKE QPYTQDLFRM | 1573 |
|  | PF-442 | MQIFYIKTKIFLSFFLFLLIFSQCFYKIEE | 1574 |
|  | PF-C252 | NYRLVNAIFSKIFKKKFIKF | 1575 |
| FIK | PF-251 | MAWKFIKLDKVVSQKECNNFLEKEENKKLLKL LRIQKNMR | 1576 |
|  | PF-261 | MDIWKFIKSFNTVNTYLLLSCVLLIILVLYFYVI NPA | 1577 |
|  | PF-497 | LVLRICTDLFTFIKWTIKQRKS | 1578 |
|  | PF-775 | DLCGQEFIKFKTCVTNQLAKK | 1579 |
|  | PF-591 | DLLKSLLGQDGAKNDEIIEFIKIIMEK | 1580 |
|  | PF-597 | DEIKVSDEEIEKFIKENNL | 1581 |
|  | PF-608 | LICEVVKPEEDFIKVKLNEDNVTAKISREFIAKKI DA | 1582 |
|  | IT-133 | YFIKDDNEALSKDWEVIGNDLKGTIDKYGKEFK VR | 1583 |
|  | PF-C252 | NYRLVNAIFSKIFKKKFIKF | 1584 |
|  | PF-C278 | DMKIIKLYIKILSFLFIKYCNKKLNSVKLKA | 1585 |
|  | PF-C290 | GNVHPESDFHNLIQFIKTFLYFTIFFKYFL | 1586 |
|  | PF-006 | MGIIAGIIKFIKGLIEKFTGK | 1587 |
|  | PF-013 | LIQKGLNQTFIVVIRLNNFIKKS | 1588 |
|  | PF-040 | MIHLTKQNTMEALHFIKQFYDMFFILNFNV | 1589 |
| KIH | PF-252 | MKKLVAALAVIVILTGCVYDPVNYDKIHDQEF QDHLRQNG | 1590 |
|  | PF-575 | LNFRAENKILEKIHISLIDTVEGSA | 1591 |
|  | PF-533 | KTPNDKIHKTIIIKHIIL | 1592 |
| HIK | PF-222 | HIKETR | 1593 |
|  | PF-319 | SIGSMIGMYSFRHKTKHIKFTFGIPFILFLQFLLV YFYILK | 1594 |
|  | PF-477 | HKNKLNIPHIKS | 1595 |
| KIV | PF-272 | MTLTIKIKHRSKIVPLNLISLVYAFFTYNFVANRI MFLTND | 1596 |
|  | PF-758 | PEIIKIVSGLL | 1597 |
|  | PF-336 | MLTSRKKRLKKIVEEQNKKDESI | 1598 |
|  | PF-C073 | FESLLPQATKKIVNNKGSKINKIF | 1599 |
|  | PF-721 | TEQAKKIVDILNNWLE | 1600 |
|  | PF-730 | FEDIEQIIKYHLIDGKIVAPLLLDR | 1601 |
|  | PF-095 | KRGSKIVIAIAVVLIVLAGVWVW | 1602 |
|  | PF-028 | ALDCSEQSVILWYETILDKIVGVIK | 1603 |
| VIK | PF-257 | VWENRKKYLENEIERHNVFLKLGQEVIKGLNA LASRGR | 1604 |
|  | PF-226 | LMFFSENMDKRDTLSGKFRYFAGSKVIKLMNW LSENGK | 1605 |
|  | PF-580 | EILNNNQVIKELTMKYKTQFESNLGGWTARARR | 1606 |
|  | PF-366 | ALCSVIKAIELGIINVHLQ | 1607 |
|  | PF-C092 | NGDKKAKEELDKWDEVIKELNIQF | 1608 |
|  | PF-S028 | GSVIKKRRKRMSKKKHRKMLRRTRVQRRKLGK | 1609 |
|  | PF-103 | VIKISVPGQVQMLIP | 1610 |
|  | PF-527 | GSVIKKRRKRMAKKKHRKLLKKTRIQRRRAGK | 1611 |
|  | PF-167 | AIEGVIKKGACFKLLRHEMF | 1612 |
|  | PF-C166 | KRKHENVIVAEEMRVIKN | 1613 |
|  | PF-007 | MGIIAGIIKVIKSLIEQFTGK | 1614 |
|  | PF-071 | HCVIGNVVDIANLLKRRAVYRDIADVIKMR | 1615 |
|  | PF-028 | ALDCSEQSVILWYETILDKIVGVIK | 1616 |
| PRP | PF-C031 | WSESQPPTATPRPHAEVARAGLVTPPTL | 1617 |
|  | PF-752 | LHVIRPRPELSELKFPITKILKVNKQGLKK | 1618 |
|  | PF-672 | MRFGSLALVAYDSAIKHSWPRPSSVRRLRM | 1619 |

TABLE 7-continued

Antimicrobial peptides characterized by particular motifs.

| Motif | Omnibus # | Sequence | SEQ ID NO |
|---|---|---|---|
| | PF-088 | VMFVLTRGRSPRPMIPAY | 1620 |
| | PF-143 | LSPRPIIVSRRSRADNNNDWSR | 1621 |
| | PF-168 | VLPFPAIPLSRRRACVAAPRPRSRQRAS | 1622 |
| | PF-531 | YIQFHLNQQPRPKVKKIKIFL | 1623 |

All groups are associated with antimicrobial activity

In certain embodiments, peptides described herein can have multiple activities. Thus for example, a peptide can have both binding/targeting activity and antimicrobial activity. Illustrative peptides having multiple activities are shown in Table 8. Such peptides can be used, e.g., in a chimeric construct, for any or all of these properties. Thus, for example, a peptide designated "B" in Table 8 can be used as a targeting peptide. If it is also designated G or M it can also be used for antimicrobial activity.

TABLE 8

Peptides having multiple activities.

| Peptide | Activities | Peptide | Activities | Peptide | Activities | Peptide | Activities |
|---|---|---|---|---|---|---|---|
| PF-001 | G B | PF-224 | G B | PF-448 | G B M | PF-592 | G B |
| PF-002 | G B | PF-226 | G B | PF-450 | G B | PF-593 | G B |
| PF-003 | G B | PF-233 | G B | PF-451 | G B | PF-594 | G B |
| PF-004 | G B | PF-234 | G B | PF-452 | G B | PF-595 | G B |
| PF-005 | G B | PF-235 | G B | PF-453 | G B | PF-596 | G B |
| PF-006 | G B M | PF-249 | G B | PF-454 | G B | PF-597 | G B |
| PF-007 | G B | PF-255 | G B | PF-456 | G B | PF-598 | G B |
| PF-008 | G B | PF-257 | G B | PF-457 | G B | PF-599 | G B |
| PF-009 | G B | PF-270 | G B | PF-458 | G B | PF-600 | G B M |
| PF-010 | G B | PF-271 | G B | PF-459 | G B | PF-601 | G B |
| PF-011 | G B | PF-273 | G B | PF-460 | G B | PF-602 | G B |
| PF-012 | G B | PF-276 | G B | PF-461 | G B | PF-603 | G B |
| PF-013 | G B | PF-278 | G B M | PF-462 | G B | PF-604 | G B |
| PF-015 | G B | PF-283 | G B M | PF-464 | G B | PF-605 | G B |
| PF-017 | G B | PF-289 | G B | PF-465 | G B | PF-606 | G M |
| PF-020 | G B | PF-292 | G B | PF-466 | G B | PF-607 | G B |
| PF-021 | G B | PF-294 | G B | PF-467 | G B | PF-609 | G B |
| PF-022 | G B | PF-297 | G B | PF-469 | G B | PF-610 | G B |
| PF-023 | G B | PF-301 | G B | PF-470 | G B | PF-612 | G B |
| PF-024 | G B | PF-305 | G B | PF-471 | G B | PF-613 | G B |
| PF-025 | G B | PF-306 | G B | PF-472 | G B | PF-614 | G B |
| PF-026 | G B | PF-307 | G B M | PF-473 | G B | PF-615 | G B |
| PF-027 | G B | PF-313 | G B | PF-474 | G B | PF-616 | G B |
| PF-028 | G B | PF-319 | G B | PF-475 | G B | PF-617 | G B |
| PF-029 | G B | PF-322 | G M | PF-476 | G B | PF-619 | G B |
| PF-030 | G B | PF-344 | G B | PF-477 | G B | PF-621 | G B |
| PF-031 | G B | PF-347 | G B | PF-478 | G B | PF-622 | G B |
| PF-033 | G B | PF-349 | G B | PF-479 | G B | PF-623 | G B |
| PF-034 | G B | PF-350 | G B | PF-480 | G B | PF-625 | G B |
| PF-035 | G B | PF-354 | G B | PF-482 | G B | PF-626 | G B |
| PF-036 | G B | PF-355 | G B | PF-484 | G B | PF-627 | G B |
| PF-037 | G B | PF-356 | G B | PF-497 | B M | PF-629 | G B |
| PF-040 | G B | PF-357 | G B | PF-499 | B M | PF-630 | G B |
| PF-041 | G B | PF-360 | G B | PF-511 | G B M | PF-631 | G B |
| PF-042 | G B | PF-362 | G B | PF-512 | G B M | PF-632 | G B |
| PF-043 | G B | PF-363 | G B | PF-513 | G B | PF-634 | G B |
| PF-045 | G B | PF-366 | G B | PF-514 | G B | PF-635 | G B |
| PF-046 | G B | PF-369 | G B | PF-515 | G B | PF-636 | G B |
| PF-048 | G B | PF-370 | G B | PF-516 | G | PF-637 | G B |
| PF-049 | G B | PF-373 | G B | PF-517 | G B | PF-638 | G B |
| PF-051 | G B | PF-374 | G B | PF-518 | G B | PF-639 | G B |
| PF-052 | G B | PF-375 | G B | PF-519 | G B | PF-640 | G B |
| PF-053 | G B | PF-376 | G B | PF-520 | G B M | PF-642 | G B |
| PF-056 | G B | PF-378 | G B | PF-521 | G B M | PF-655 | G B |
| PF-057 | G B | PF-379 | G B | PF-522 | G B M | PF-664 | G B |
| PF-058 | G B | PF-380 | G B | PF-523 | B M | PF-672 | G B M |
| PF-061 | G B | PF-381 | G B | PF-524 | G B M | PF-681 | G B |
| PF-063 | G B | PF-382 | G B | PF-525 | G M | PF-686 | G B |
| PF-064 | G B | PF-383 | G B | PF-526 | G B | PF-737 | G B |
| PF-065 | G B | PF-385 | G B | PF-527 | G B M | PF-738 | G B |
| PF-066 | G B | PF-386 | G B | PF-528 | G B | PF-741 | G B |
| PF-067 | G B | PF-387 | G B | PF-529 | G B M | PF-744 | G B |
| PF-068 | G B | PF-389 | G B | PF-530 | G M | PF-745 | G B |

TABLE 8-continued

Peptides having multiple activities.

| Peptide | Activities | Peptide | Activities | Peptide | Activities | Peptide | Activities |
|---|---|---|---|---|---|---|---|
| PF-069 | G B | PF-390 | G B | PF-531 | G M | PF-746 | G B |
| PF-070 | G B | PF-392 | G B | PF-537 | G B | PF-748 | G B |
| PF-071 | G B | PF-393 | G B | PF-538 | G M | PF-749 | G B |
| PF-073 | G B | PF-394 | G B | PF-539 | G B | PF-752 | G B |
| PF-074 | G B | PF-395 | G B | PF-540 | G B | PF-756 | G B |
| PF-075 | G B | PF-396 | G B | PF-542 | G B | PF-757 | G B |
| PF-076 | G B | PF-397 | G B | PF-543 | G B | PF-760 | G B |
| PF-099 | G B | PF-398 | G B | PF-544 | G B | PF-761 | G B |
| PF-123 | G B | PF-399 | G B | PF-545 | G B M | PF-762 | G B |
| PF-124 | G B | PF-401 | G B | PF-546 | G B | PF-763 | G B |
| PF-125 | G B | PF-403 | G B | PF-547 | G B M | PF-764 | G B |
| PF-127 | G B | PF-404 | G B | PF-548 | G B | PF-770 | G B |
| PF-128 | G B | PF-405 | G B | PF-549 | G B | PF-776 | G B |
| PF-129 | G B | PF-406 | G B | PF-550 | G B | PF-C052 | G B |
| PF-133 | G B | PF-407 | G B | PF-551 | G B | PF-C055 | G B |
| PF-135 | G B | PF-408 | G B | PF-552 | G B | PF-C057 | G B |
| PF-137 | G B | PF-410 | G B | PF-553 | G B | PF-C058 | G B |
| PF-139 | G B | PF-411 | G B | PF-554 | G B | PF-C061 | G B |
| PF-140 | G B | PF-413 | G B | PF-555 | G B | PF-C062 | G B |
| PF-143 | G B | PF-414 | G B | PF-556 | G B | PF-C064 | G B |
| PF-144 | G B | PF-416 | G B | PF-557 | G B | PF-C065 | G B |
| PF-145 | G B | PF-417 | G B | PF-558 | G B | PF-C069 | G B |
| PF-148 | G B M | PF-418 | G B | PF-559 | G B | PF-C071 | G B |
| PF-149 | G B | PF-421 | G B | PF-560 | G B | PF-C072 | G B |
| PF-153 | G B | PF-422 | G B | PF-562 | G B | PF-C075 | G B |
| PF-156 | G B | PF-423 | G B | PF-563 | G B | PF-C084 | G B |
| PF-157 | G B | PF-424 | G B | PF-564 | G B | PF-C085 | G B |
| PF-164 | G B | PF-425 | G B | PF-566 | G B | PF-C086 | G B |
| PF-168 | G B M | PF-426 | G B | PF-567 | G B | PF-C088 | G B |
| PF-171 | G B | PF-427 | G B | PF-569 | G B | PF-C091 | G B |
| PF-173 | G B | PF-428 | G B | PF-572 | G B | PF-C095 | G B |
| PF-175 | G B | PF-429 | G B | PF-573 | G B | PF-C098 | G B |
| PF-176 | G B | PF-430 | G B | PF-575 | G B | PF-C120 | G B |
| PF-178 | G B | PF-431 | G B | PF-576 | G B | PF-C131 | G B |
| PF-180 | G B | PF-432 | G B | PF-577 | G B | PF-C135 | G B |
| PF-186 | G B | PF-433 | G B | PF-578 | G B | PF-C136 | G B |
| PF-188 | G B | PF-434 | G B | PF-580 | G B | PF-C137 | G B |
| PF-190 | G B | PF-437 | G M | PF-581 | G B | PF-C139 | G B |
| PF-191 | G B | PF-439 | G B | PF-583 | G B M | PF-C142 | G B |
| PF-192 | G B | PF-440 | G B | PF-584 | G B | PF-C143 | G B |
| PF-196 | G B | PF-442 | G B | PF-585 | G B | PF-C145 | G B |
| PF-203 | G B | PF-443 | G B | PF-586 | G B | PF-C180 | G B |
| PF-204 | G B | PF-444 | G B | PF-587 | G B | PF-C181 | G B |
| PF-208 | G B | PF-445 | G B | PF-588 | G B | PF-C194 | G B |
| PF-209 | G B M | PF-446 | G B | PF-589 | G B | PF-C281 | G B |
| PF-212 | G B | PF-447 | G B | PF-590 | G B | PF-C290 | G B |
| PF-215 | G B | PF-S003 | G B | | | PF-C291 | G B |

B: targeting/binding activity;
M: antimicrobial activity;
G: Growth or phenotype altering.

Other peptides believed to show binding, growth altering, and/or antimicrobial activity are shown in Table 9.

TABLE 9

Additional peptides believed to have binding, growth altering, and/or antimicrobial activity.

| ID | Sequence | SEQ ID No. |
|---|---|---|
| PF-198 | RRLASRRSLVVST | 1624 |
| PF-227 | RLLGLYGENSAAGFIASVIGAVIILFIYNLIARKS | 1625 |
| PF-260 | GHLRVCWILWLQSANPLSFRHHYLAVMW | 1626 |
| PF-261 | MDIWKFIKSFNTVNTYLLLSCVLLIILVLYFYVINPA | 1627 |
| PF-277 | MIIQNKKIEKIYKYQTKEIFLNKTSLRAGFVFRMVRVLI | 1628 |
| PF-280 | MLIDWQEPDIEKSFCAAFLKISVSVLVYRTPLGYGNQLRE | 1629 |

TABLE 9-continued

Additional peptides believed to have binding, growth altering, and/or antimicrobial activity.

| ID | Sequence | SEQ ID No. |
|---|---|---|
| PF-286 | FFDGEVGCGC | 1630 |
| PF-287 | ILEQNIEEVFFIQS | 1631 |
| PF-312 | MDKIRIWNNFHISNEYIKQRYGIISIPLFYVYLF | 1632 |
| PF-321 | FAKKNPCRMRVPNTGTWYLVVNQDGNSGIVNFSINTIQN | 1633 |
| PF-327 | MLVFQMRYQMRYVDKTSTVLKQTKNSDYADK | 1634 |
| PF-330 | MLMNFEVYQQRILIIYNKCYHLKAVGKNLQLFIIVD | 1635 |
| PF-331 | MGRHLWNPSYFVATVSENTEEQIRKYINNQKKQVK | 1636 |
| PF-341 | DDKNEGKIAQGEY | 1637 |
| PF-391 | EASVYRE | 1638 |
| PF-420 | MVKHNFDVTDKTGKISSKHCFEITDKTDVV | 1639 |
| PF-708 | DRPSQTTHHTLSSSRITGPS | 1640 |
| PF-710 | EALLPPDPPDEDSQRIIPQ | 1641 |
| PF-713 | DRPSQTTHHTLSSSRITGPS | 1642 |
| PF-715 | LEDTKALFPCFVPI | 1643 |
| PF-718 | KKYSSFKSMIDDLEYDA | 1644 |
| PF-719 | FKSMIDDLEYDA | 1645 |
| PF-721 | TEQAKKIVDILNNWLE | 1646 |
| PF-722 | STSPSVTSVYAEALGLK | 1647 |
| PF-723 | VGAMAIFLNVVAMLAGV | 1648 |
| PF-725 | ARTIQNNGCLIHNSRYP | 1649 |
| PF-726 | CDDLYALEAQGTLNELLKK | 1650 |
| PF-729 | TPEPVVIVKP | 1651 |
| PF-730 | FEDIEQIIKYHLIDGKIVAPLLLDR | 1652 |
| PF-734 | SDIIAEMFQQGELEPMLRDAVAA | 1653 |
| PF-736 | KGSASGSASGSGSAK | 1654 |
| PF-739 | KSGASSVASAAKSG | 1655 |
| PF-742 | AAATTATTAK | 1656 |
| PF-743 | TKGTTTGTAKTTGVTTGTAK | 1657 |
| PF-769 | GSRGGAKRGGARG | 1658 |
| PF-C031 | WSESQPPTATPRPHAEVARAGLVTPPTL | 1659 |
| PF-C038 | QPIGFPTDSVHGTDLVHRLRGTTSSR | 1660 |
| PF-C077 | LENLDIEGLTEMKEHIEDLIAEKSAAESIEEVIVEAE | 1661 |
| PF-C205 | AYSLTFQNPNDNLTDEEVAKYMEKITKALTEKIGAEVR | 1662 |
| PF-S016 | PLTRETFAERGIRKARVARTFSEEEPPF | 1663 |

III. Design and Construction of STAMPs and Other Chimeric Constructs.

In various embodiments this invention provides chimeric moieties comprising one or more targeting moieties attached to one or more effectors. The targeting moieties can be selected to preferentially bind to a target microorganism (e.g., bacteria, virus, fungi, yeast, alga, protozoan, etc.) or group of microorganisms (e.g., gram-negative or gram-positive bacteria, particular genus, species, etc.) In certain embodiments the targeting moiety comprises one or more novel microorganism-binding peptides as described herein (see, e.g., Table 3, and/or Table 10, and/or Table 12). In certain embodiments the targeting moiety comprises non-peptide moieties (e.g., antibodies, receptor, receptor ligand, lectin, and the like).

In various embodiments the effector comprises a moiety whose activity is to be delivered to the target microorganism(s), to a biofilm comprising the target microorganism(s), to a cell or tissue comprising the target microorganism(s), and the like. In certain embodiments the targeting moiety comprises one or more antimicrobial peptide(s) as described herein (see, e.g., Tables 4, 5 and/or 14), an antibiotic (including, but not limited to a steroid antibiotic), a detectable label, a porphyrin, a photosensitizing agent, an epitope tag, a lipid or liposome, a nanoparticle, a dendrimer, and the like.

In certain embodiments one or more targeting moieties are attached to a single effector. In certain embodiments one or more effectors are attached to a single targeting moiety. In certain embodiments multiple targeting moieties are attached to multiple effectors. The targeting moieties(s) can be attached directly to the effector(s) or through a linker. Where the targeting moiety and the effector comprise peptides the chimeric moiety can be a fusion protein.

A) Targeting Moieties.

In various embodiments this invention provides targeting moieties that preferentially and/or specifically bind to a microorganism (e.g., a bacterium, a fungus, a yeast, etc.). One or more such targeting moieties can be attached to one or more effectors to provide chimeric moieties that are capable of delivering the effector(s) to a target (e.g., a bacterium, a fungus, a yeast, a biofilm comprising the bacterium or fungus or yeast, etc.).

In various embodiments, targeting moieties include, but are not limited to peptides that preferentially bind particular microorganisms (e.g., bacteria, fungi, yeasts, protozoa, algae, viruses, etc.) or groups of such microorganisms, e.g., as described above, antibodies that bind particular microorganisms or groups of microorganisms, receptor ligands that bind particular microorganisms or groups of microorganisms, porphyrins (e.g., metalloporphyrins), lectins that bind particular microorganisms or groups of microorganisms, and the like. As indicated it will be appreciated that references to microorganisms or groups of microorganism include bacteria or groups of bacteria, viruses or groups of viruses, yeasts or groups of yeasts, protozoa or groups of protozoa, viruses or groups of viruses, and the like.

i. Targeting Peptides.

In certain embodiments, the targeting moiety comprises one or more targeting peptides that bind particular bacteria, fungi, and/or yeasts, and/or algae, and/or viruses and/or that bind particular groups of bacteria, and/or groups of fungi, and/or groups of yeasts, and/or groups of algae.

In certain embodiments the targeting peptide can comprise one or more domains capable of binding, specifically binding, or preferentially binding to a microorganism, e.g., a target microbial organism (see, e.g., Table 3). In certain embodiment, the targeting peptide be identified via screening peptide libraries. For example, a phage display peptide library can be screened against a target microbial organism or a desired antigen or epitope thereof. Any peptide identified through such screening can be used as a targeting peptide for the target microbial organism. Illustrative additional targeting peptides are shown in Table 10.

TABLE 10

Additional illustrative targeting moieties.

| Targeting Moiety/Organism | Structure/sequence | SEQ ID NO |
|---|---|---|
| LPSB-1 | RGLRRLGRRGLRRLGR | 1664 |
| Phob-1 | KPVLPVLPVLPVL | 1665 |
| LPSB-2 | VLRIIRIAVLRIIRIA | 1666 |
| LPTG-1 | LPETGGSGGSLPETG | 1667 |
| α-1 | RAHIRRAHIRR | 1668 |
| ANION-1 | DEDEDDEEDDDEEE | 1669 |
| PHILIC-1 | STMCGSTMCGSTMCG | 1670 |
| SA5.1/S. aureus | VRLPLWLPSLNE | 1671 |
| SA5.3/S. aureus | ANYFLPPVLSSS | 1672 |
| SA5.4/S. aureus | SHPWNAQRELSV | 1673 |
| SA5.5/S. aureus | SVSVGMRPMPRP | 1674 |
| SA5.6/S. aureus | WTPLHPSTNRPP | 1675 |
| SA5.7/S. aureus | SVSVGMKPSPRP | 1676 |
| SA5.8/S. aureus | SVSVGMKPSPRP | 1677 |
| SA5.9/S. aureus | SVPVGPYNESQP | 1678 |
| SA5.10/S. aureus | WAPPLFRSSLFY | 1679 |

TABLE 10-continued

Additional illustrative targeting moieties.

| Targeting Moiety/Organism | Structure/sequence | SEQ ID NO |
|---|---|---|
| SA2.2/*S. aureus* | WAPPXPXSSLFY | 1680 |
| SA2.4/*S. aureus* | HHGWTHHWPPPP | 1681 |
| SA2.5/*S. aureus* | SYYSLPPIFHIP | 1682 |
| SA2.6/*S. aureus* | HFQENPLSRGGEL | 1683 |
| SA2.7/*S. aureus* | FSYSPTRAPLNM | 1684 |
| SA2.8/*S. aureus* | SXPXXMKXSXXX | 1685 |
| SA2.9/*S. aureus* | VSRHQSWHPHDL | 1686 |
| SA2.10/*S. aureus* | DYXYRGLPRXET | 1687 |
| SA2.11/*S. aureus* | SVSVGMKPSPRP | 1688 |
| *S. aureus*/Consensus | V/Q/H-P/H-H-E-F/Y-K/H-H/A-L/H-X-X-K/R-P/L | 1689 |
| DH5.1/*E coli.* | KHLQNRSTGYET | 1690 |
| DH5.2/*E coli.* | HIHSLSPSKTWP | 1691 |
| DH5.3/*E coli.* | TITPTDAEMPFL | 1692 |
| DH5.4/*E coli.* | HLLESGVLERGM | 1693 |
| DH5.5/*E coli.* | HDRYHIPPLQLH | 1694 |
| DH5.6/*E coli.* | VNTLQNVRHMAA | 1695 |
| DH5.7/*E coli.* | SNYMKLRAVSPF | 1696 |
| DH5.8/*E coli.* | NLQMPYAWRTEF | 1697 |
| DH5.9/*E coli.* | QKPLTGPHFSLI | 1698 |
| CSP/*S. mutans* | SGSLSTFFRLFNRSFTQALGK | 1699 |
| CSPC18/*S. mutans* | LSTFFRLFNRSFTQALGK | 1700 |
| CSPC16/*S. mutans* | TFFRLFNRSFTQALGK | 1701 |
| CSPM8/*S. mutans* | TFFRLFNR | 1702 |
| KH/*Pseudomonas* spp (US 2004/0137482) | KKHRKHRKHRKH | 1703 |
| cCF10 | LVTLVFV | 1704 |
| AgrD1 | YSTCDFIM | 1705 |
| AgrD2 | GVNACSSLF | 1706 |
| AgrD3 | YINCDFLL | 1707 |
| NisinA | ITSISLCTPGCKTGALMGCNMRTATCIICSIIIVSK | 1708 |
| PlnA | KSSAYSLQMGATAIKQVKKLFKKWGW | 1709 |
| S3L1-5 | WWYNWWQDW | 1710 |
| Penetratin | RQIKIWFWNRRMKWKK* | 1711 |
| Tat | EHWSYCDLRPG | 1712 |
| Pep-1N | KETWWETWWTEW | 1713 |
| Pep27 | MRKEFHNVLSSGQLLADKRPARDYNRK | 1714 |
| HABP35 | LKQKIKHVVKLKVVVKLRSQLVKRKQN | 1715 |
| HABP42 (all D) | STMMSRSHKTRSHHV | 1716 |

TABLE 10-continued

| Additional illustrative targeting moieties. | | |
|---|---|---|
| Targeting Moiety/ Organism | Structure/sequence | SEQ ID NO |
| HABP52 | GAHWQFNALTVRGGGS | 1717 |
| Hi3/17 | KQRTSIRATEGCLPS | 1718 |
| α-*E. coli* peptide | QEKIRVRLSA | 1719 |
| Salivary Receptor Adhesion Fragment | QLKTADLPAGRDETTSFVLV* | 1720 |
| S1 (Sushi frag.) (LPS binding) | GFKLKGMARISCLPNGQWSNFPPKCIRECAMVSS | 1721 |
| S3 (Sushi frag.) (LPS binding) | HAEHKVKIGVEQKYGQFPQGTEVTYTCSGNYFLM | 1722 |
| MArg.1 (Mycoplasma infected cell line binding peptide | AMDMYSIEDRYFGGYAPEVG | 1723 |
| BPI fragment 1 (LPS binding) 6,376,462 | ASQQGTAALQKELKRIKPDYSDSFKIKH | 1724 |
| BPI fragment 2 (LPS binding) 6,376,462 | SSQISMVPNVGLKFSISNANIKISGKWKAQKRFLK | 1725 |
| BPI fragment 3 (LPS binding) 6,376,462 | VHVHISKSKVGWLIQLFHKKIESALRNK | 1726 |
| LBP fragment 1 (LPS binding) 6,376,462 | AAQEGLLALQSELLRITLPDFTGDLRIPH | 1727 |
| LBP fragment 2 (LPS binding) 6,376,462 | HSALRPVPGQGLSLSISDSSIRVQGRWKVRKSFFK | 1728 |
| LBP fragment 3 (LPS binding) 6,376,462 | VEVDMSGDLGWLLNLFHNQIESKFQKV | 1729 |
| *B. anthracis* spore binding (WO/1999/036081) | ATYPLPIR | 1730 |
| *Bacillus* spore binding (WO/1999/036081) | peptides of 5-12 amino acids containing the sequence Asn-His-Phe-Leu | 1731 |
| | peptides of 5-12 amino acids containing the sequence Asn-His-Phe-Leu-Pro | 1732 |
| | Thr-Ser-Glu-Asn-Val-Arg-Thr (TSQNVRT) | 1733 |
| | A peptide of formula Thr-Tyr-Pro-X-Pro-X-Arg (TYPXPXR) where X is a Ile, Val or Leu. | 1734 |
| | A peptide having the sequence TSQNVRT. | 1735 |
| | A peptide having the sequence TYPLPIR | 1736 |
| LPS binding peptide 1 (6,384,188) | TFRRLKWK | 1737 |
| LPS BP 2 (6,384,188) | RWKVRKSFFKLQ | 1738 |
| LPS BP 3 (6,384,188) | KWKAQKRFLKMS | 1739 |
| *Pseudomonas* pilin binding peptide (5,494,672) | KCTSDQDEQFIPKGCSK | 1740 |
| RNAII inhibiting peptide (*S. Aureus*) | YSPWTNF | 1741 |

Patents and patent publications disclosing the referenced antibodies are identified in the table.

In certain embodiments the targeting moieties can comprise other entities, particularly when utilized with an antimicrobial peptide as described, for example, in Table 4. Illustrative targeting moieties can include a polypeptide, a peptide, a small molecule, a ligand, a receptor, an antibody, a protein, or portions thereof that specifically interact with a target microbial organism, e.g., the cell surface appendages such as flagella and pili, and surface exposed proteins, lipids and polysaccharides of a target microbial organism.

ii. Targeting Antibodies.

In certain embodiments the targeting moieties can comprise one or more antibodies that bind specifically or preferentially a microorganism or group of microorganisms (e.g., bacteria, fungi, yeasts, protozoa, viruses, algae, etc.). The antibodies are selected to bind an epitope characteristic or the particular target microorganism(s). In various embodiments such epitopes or antigens are typically is gram-positive or gram-negative specific, or genus-specific, or species-specific, or strain specific and located on the surface of a target microbial organism. The antibody that binds the epitope or antigen can direct an anti-microbial peptide moiety or other effector to the site. Furthermore, in certain embodiments the antibody itself can provide anti-microbial activity in addition to the activity provided by effector moiety since the antibody may engage an immune system effector (e.g., a T-cell) and thereby elicit an antibody-associated immune response, e.g., a humoral immune response.

Antibodies that bind particular target microorganisms can be made using any methods readily available to one skilled in the art. For example, as described in U.S. Pat. No. 6,231,857 (incorporated herein by reference) three monoclonal antibodies, i.e., SWLA1, SWLA2, and SWLA3 have been made against *S. mutans*. Monoclonal antibodies obtained from non-human animals to be used in a targeting moiety can also be humanized by any means available in the art to decrease their immunogenicity and increase their ability to elicit anti-microbial immune response of a human. Illustrative microorganisms and/or targets to which antibodies may be directed are shown, for example, in Tables 3 and 11.

Various forms of antibody include, without limitation, whole antibodies, antibody fragments (e.g., (Fab')$_2$ Fab', etc.), single chain antibodies (e.g., scFv), minibodies, Di-miniantibody, Tetra-miniantibody, (scFv)$_2$, Diabody, scDiabody, Triabody, Tetrabody, Tandem diabody, VHH, nanobodies, affibodies, unibodies, and the like.

Methods of making such antibodies are well known to those of skill in the art. In various embodiments, such methods typically involve providing the microorganism, or a component thereof for use as an antigen to raise an immune response in an organism or for use in a screening protocol (e.g., phage or yeast display).

For example, polyclonal antibodies are typically raised by one or more injections (e.g. subcutaneous or intramuscular injections) of the target microorganism(s) or components thereof into a suitable non-human mammal (e.g., mouse, rabbit, rat, etc.).

If desired, the immunizing microorganism or antigen derived therefrom can be administered with or coupled to a carrier protein by conjugation using techniques that are well-known in the art. Such commonly used carriers which are chemically coupled to the peptide include keyhole limpet hemocyanin (KLH), thyroglobulin, bovine serum albumin (BSA), and tetanus toxoid. The coupled peptide is then used to immunize the animal (e.g. a mouse or a rabbit).

The antibodies are then obtained from blood samples taken from the mammal. The techniques used to develop polyclonal antibodies are known in the art (see, e.g., *Methods of Enzymology*, "Production of Antisera With Small Doses of Immunogen: Multiple Intradermal Injections", Langone, et al. eds. (Acad. Press, 1981)). Polyclonal antibodies produced by the animals can be further purified, for example, by binding to and elution from a matrix to which the peptide to which the antibodies were raised is bound. Those of skill in the art will know of various techniques common in the immunology arts for purification and/or concentration of polyclonal antibodies, as well as monoclonal antibodies see, for example, Coligan, et al. (1991) Unit 9, *Current Protocols in Immunology*, Wiley Interscience).

In certain embodiments the antibodies produced will be monoclonal antibodies ("mAb's"). The general method used for production of hybridomas secreting mAbs is well known (Kohler and Milstein (1975) *Nature*, 256:495

Antibody fragments, e.g. single chain antibodies (scFv or others), can also be produced/selected using phage display and/or yeast display technology. The ability to express antibody fragments on the surface of viruses that infect bacteria (bacteriophage or phage) or yeasts makes it possible to isolate a single binding antibody fragment, e.g., from a library of greater than $10^{10}$ nonbinding clones. To express antibody fragments on the surface of phage (phage display) or yeast, an antibody fragment gene is inserted into the gene encoding a phage surface protein (e.g., pIII) and the antibody fragment-pIII fusion protein is displayed on the phage surface (McCafferty et al. (1990) *Nature*, 348: 552-554; Hoogenboom et al. (1991) *Nucleic Acids Res*. 19: 4133-4137).

Since the antibody fragments on the surface of the phage or yeast are functional, phage bearing antigen binding antibody fragments can be separated from non-binding phage by antigen affinity chromatography (McCafferty et al. (1990) *Nature*, 348: 552-554). Depending on the affinity of the antibody fragment, enrichment factors of 20 fold—1,000,000 fold are obtained for a single round of affinity selection.

Human antibodies can be produced without prior immunization by displaying very large and diverse V-gene repertoires on phage (Marks et al. (1991) *J. Mol. Biol.* 222: 581-597.

In certain embodiments, nanobodies can be used as targeting moieties. Methods of making V$_h$H (nanobodies) are also well known to those of skill in the art. The Camelidae heavy chain antibodies are found as homodimers of a single heavy chain, dimerized via their constant regions. The variable domains of these camelidae heavy chain antibodies are referred to as V$_{HH}$ domains or V$_{HH}$, and can be either used per se as nanobodies and/or as a starting point for obtaining nanobodies. Isolated V$_{HH}$ retain the ability to bind antigen with high specificity (see, e.g., Hamers-Casterman et al. (1993) *Nature* 363: 446-448). In certain embodiments such V$_{HH}$ domains, or nucleotide sequences encoding them, can be derived from antibodies raised in Camelidae species, for example in camel, dromedary, llama, alpaca and guanaco. Other species besides Camelidae (e.g. shark, pufferfish) can produce functional antigen-binding heavy chain antibodies, from which (nucleotide sequences encoding) such naturally occurring V$_{HH}$ can be obtained, e.g. using the methods described in U.S. Patent Publication US 2006/0211088.

In various embodiments, for use in therapy, human proteins are preferred, primarily because they are not as likely to provoke an immune response when administered to a patient. Comparisons of camelid V$_{HH}$ with the V$_H$ domains of human antibodies reveals several key differences in the framework regions of the camelid V$_{HH}$ domain corresponding to the V$_H$/V$_L$ interface of the human V$_H$ domains. Mutation of these human residues to V$_{HH}$ resembling residues has been performed to produce "camelized" human $V_H$ domains that retain antigen binding activity, yet have improved expression and solubility.

Libraries of single $V_H$ domains have also been derived for example from $V_H$ genes amplified from genomic DNA or from mRNA from the spleens of immunized mice and expressed in E. coli (Ward et al. (1989) Nature 341: 544-546) and similar approaches can be performed using the $V_H$ domains and/or the $V_L$ domains described herein. The isolated single VH domains are called "dAbs" or domain antibodies. A "dAb" is an antibody single variable domain ($V_H$ or $V_L$) polypeptide that specifically binds antigen. A "dAb" binds antigen independently of other V domains; however, as the term is used herein, a "dAb" can be present in a homo- or heteromultimer with other $V_H$ or $V_L$ domains where the other domains are not required for antigen binding by the dAb, i.e., where the dAb binds antigen independently of the additional $V_H$ or $V_L$ domains.

As described in U.S. Patent Publication US 2006/0211088 methods are known for the cloning and direct screening of immunoglobulin sequences (including but not limited to multivalent polypeptides comprising: two or more variable domains—or antigen binding domains—and in particular $V_H$ domains or $V_{HH}$ domains; fragments of $V_L$, $V_H$ or $V_{HH}$ domains, such as CDR regions, for example CDR3 regions; antigen-binding fragments of conventional 4-chain antibodies such as Fab fragments and scFv's, heavy chain antibodies and domain antibodies; and in particular of $V_H$ sequences, and more in particular of $V_{HH}$ sequences) that can be used as part of and/or to construct such nanobodies.

Methods and procedures for the production of VHH/nanobodies can also be found for example in WO 94/04678, WO 96/34103, WO 97/49805, WO 97/49805 WO 94/25591, WO 00/43507 WO 01/90190, WO 03/025020, WO 04/062551, WO 04/041863, WO 04/041865, WO 04/041862, WO 04/041867, PCT/BE2004/000159, Hamers-Casterman et al. (1993) Nature 363: 446; Riechmann and Muyldermans (1999) J. Immunological Meth., 231: 25-38; Vu et al. (1997) Molecular Immunology, 34(16-17): 1121-1131; Nguyen et al. (2000) EMBO J., 19(5): 921-930; Arbabi Ghahroudi et al. (19997) FEBS Letters 414: 521-526; van der Linden et al. (2000) J. Immunological Meth., 240: 185-195; Muyldermans (2001) Rev. Molecular Biotechnology 74: 277-302; Nguyen et al. (2001) Adv. Immunol. 79: 261, and the like.

In certain embodiments the antibody targeting moiety is a unibody. Unibodies provide an antibody technology that produces a stable, smaller antibody format with an anticipated longer therapeutic window than certain small antibody formats. In certain embodiments unibodies are produced from IgG4 antibodies by eliminating the hinge region of the antibody. Unlike the full size IgG4 antibody, the half molecule fragment is very stable and is termed a uniBody. Halving the IgG4 molecule left only one area on the UniBody that can bind to a target. Methods of producing unibodies are described in detail in PCT Publication WO2007/059782, which is incorporated herein by reference in its entirety (see, also, Kolfschoten et al. (2007) Science 317: 1554-1557).

Affibody molecules are class of affinity proteins based on a 58-amino acid residue protein domain, derived from one of the IgG-binding domains of staphylococcal protein A. This three helix bundle domain has been used as a scaffold for the construction of combinatorial phagemid libraries, from which Affibody variants that target the desired molecules can be selected using phage display technology (see, e.g., Nord et al. (1997) Nat. Biotechnol. 15: 772-777; Ronmark et al. (2002) Eur. J. Biochem., 269: 2647-2655). Details of Affibodies and methods of production are known to those of skill (see, e.g., U.S. Pat. No. 5,831,012 which is incorporated herein by reference in its entirety).

It will also be recognized that antibodies can be prepared by any of a number of commercial services (e.g., Berkeley antibody laboratories, Bethyl Laboratories, Anawa, Eurogenetec, etc.).

Illustrative antibodies that bind various microorganisms are shown in Table 11.

TABLE 11

Illustrative antibodies that bind target microorganisms.

| Source | Antibody |
|---|---|
| U.S. Pat. No. 7,195,763 | Polyclonal/monoclonal binds specific Gram(+) cell wall repeats |
| U.S. Pat. No. 6,939,543 | Antibodies against G(+) LTA |
| U.S. Pat. No. 7,169,903 | Antibodies against G(+) peptidoglycan |
| U.S. Pat. No. 6,231,857 | Antibody against S. mutans (Shi) |
| U.S. Pat. No. 5,484,591 | Gram(−) binding antibodies |
| US 2007/0231321 | Diabody binding to Streptococcus surface antigen I/II |
| US 2003/0124635 | Antibody against S. mutans |
| US 2006/0127372 | Antibodies to Actinomyces naeslundii, Lactobacillus casei |
| US 2003/0092086 | Antibody to S. sobrinus |
| U.S. Pat. No. 7,364,738 | Monoclonal antibodies to the ClfA protein in S. aureus |
| U.S. Pat. No. 7,632,502 | Antibodies against C. albicans |
| U.S. Pat. No. 7,608,265 | Monoclonal against C. difficile |
| U.S. Pat. No. 4,777,136 | Monoclonal Antibodies against Pseudomonas aeruginosa |
| see, e.g., ab20429, ab20560, ab79522, ab35165, ab65602 from AbCAMm Cambridge Science Park, U.K. | Antibody against S. pneumoniae |

In addition, antibodies (targeting moieties) that bind other microorganisms can readily be produced using, for example, the methods described above.

iii. Porphyrins.

In certain embodiments porphyrins, or other photosensitizing agents, can be used as targeting moieties in the constructs described herein. In particular, metalloporphyrins, particularly a number of non-iron metalloporphyrins mimic heme in their molecular structure and are actively accumulated by bacteria via high affinity heme-uptake systems. The same uptake systems can be used to deliver antibiotic-porphyrin and antibacterial-porphyrin conjugates. Illustrative targeting porphyrins suitable for this purpose are described in U.S. Pat. No. 6,066,628 and shown herein, for example, in FIGS. 1 and 2.

For example, certain artificial (non-iron) metalloporphyrins (MPs) (Ga—IX, Mn—IX), are active against Gram-negative and Gram-positive bacteria and acid-fast bacilli (e.g., *Y. enterocolitica, N. meningitides, S. marcescens, E. coli, P. mirabills, K. pneumoniae, K. oxytoca, Ps. aeruginosa, C. freundii, E. aerogenes, F. menigosepticum, S. aureus, B. subtilis, S. pyogenes A, E. faecalis, M. smegmatis, M. bovis, M. tuber., S. crevisiae*) as described in Tables 1-5 of U.S. Pat. No. 6,066,628. These MPs can be used as targeting moieties against these microorganisms.

Similarly, some MPs are also growth-inhibitory against yeasts, indicating their usefulness targeting moieties to target *Candida* species (e.g., *Candida albicans, C. krusei, C. pillosus, C. glabrata*, etc.) and other mycoses including but not limited to those caused by as *Trichophyton, Epidermophyton, Histoplasma, Aspergillus, Cryptococcus*, and the like.

Porphyrins, and other photosensitizers, also have antimicrobial activity. Accordingly, in certain embodiments, the porphyrins, or other photosensitizers, can be used as effectors (e.g., attached to targeting peptides as described herein). In various embodiments the porphyrins or other photosensitizers can provide a dual functionality, e.g., as a targeting moiety and an antimicrobial and can be attached to a targeting peptide and/or to an antimicrobial peptide as described herein.

Illustrative porphyrins and other photosensitizers are shown in FIGS. 1-11 and described in more detail in the discussion of effectors below.

iv. Pheromones.

In certain embodiments, pheromones from microorganisms can be used as targeting moieties. Illustrative pheromones from bacteria and fungi are shown in Table 12.

TABLE 12

Illustrative bacterial and fungal pheromones utilizable as targeting moieties.

| Locus tag | Product | Sequence | SEQ ID |
|---|---|---|---|
| Bacterial Pheromones | | | |
| gi\|1041118\|dbj\|BAA11198.1\| | iPD1 [*Enterococcus faecalis*] | MKQQKKHIAALLF ALILTLVS | 1742 |
| gi\|1113947\|gb\|AAB35253.1\| | iAM373sex pheromone inhibito [*Enterococcus faecalis*, Peptide, 7 aa] | SIFTLVA | 1743 |
| gi\|115412\|sp\|P13268.1\|CAD1_ENTFA | Sex pheromone CAD1 | LFSLVLAG | 1744 |
| gi\|116406\|sp\|P11932.1\|CIA_ENTFA | Sex pheromone cAM373 (Clumping-inducing agent) (CIA) | AIFILAS | 1745 |
| gi\|117240\|sp\|P13269.1\|CPD1_ENTFA | Sex pheromone cPD1 | FLVMFLSG | 1746 |
| gi\|12056953\|gb\|AAG48144.1\|AF322594_1 | putative peptide pheromone PrcA [*Lactobacillus paracasei*] | DSIRDVSPTFNKIRR WFDGLFK | 1747 |
| gi\|123988\|sp\|P24803.1\|IAD1_ENTFA | Sex pheromone inhibitor determinant precursor (iAD1) | MSKRAMKKIIPLIT LFVVTLVG | 1748 |
| gi\|126362994\|emb\|CAM35812.1\| | precursor of pheromone peptide ComX [*Bacillus amyloliquefaciens* FZB42] | KDEIYWKPS | 1749 |
| gi\|1587088\|prf\|\|2205353A | pheromone | YSTCDFIM | 1750 |
| gi\|15900442\|ref\|NP_345046.1\| | peptide pheromone BlpC [*Streptococcus pneumoniae* TIGR4] | GLWEDLLYNINRY AHYIT | 1751 |
| gi\|1617436\|emb\|CAA66791.1\| | competence pheromone [*Streptococcus gordonii*] | DIRHRINNSIWRDIF LKRK | 1752 |
| gi\|1617440\|emb\|CAA66786.1\| | competence pheromone [*Streptococcus gordonii*] | DVRSNKIRLWWEN IFFNKK | 1753 |
| gi\|18307870\|gb\|AAL67728.1\|AF456134_2 | ComX pheromone precursor [*Bacillus mojavensis*] | PTTREWDG | 1754 |
| gi\|18307874\|gb\|AAL67731.1\|AF456135_2 | ComX pheromone precursor [*Bacillus mojavensis*] | LQIYTNGNWVPS | 1755 |
| gi\|29377808\|ref\|NP_816936.1\| | sex pheromone inhibitor determinant [*Enterococcus faecalis* V583] | MSKRAMKKIIPLIT LFVVTLVG | 1756 |

TABLE 12-continued

Illustrative bacterial and fungal pheromones utilizable as targeting moieties.

| Locus tag | Product | Sequence | SEQ ID |
|---|---|---|---|
| gi\|3342125\|gb\|AAC27522.1\| | putative pheromone [*Enterococcus faecium*] | GAGKNLIYGMGYGYLRSCNRL | 1757 |
| gi\|41018893\|sp\|P60242.1\|CSP1_STRPN | Competence-stimulating peptide type 1 precursor (CSP-1) | EMRLSKFFRDFILQRKK | 1758 |
| gi\|57489126\|gb\|AAW51333.1\| | PcfP [*Enterococcus faecalis*] | WSEIEINTKQSN | 1759 |
| gi\|57489152\|gb\|AAW51349.1\| | PrgT [*Enterococcus faecalis*] | HISKERFEAY | 1760 |
| gi\|58616083\|ref\|YP_195761.1\| | UvaF [*Enterococcus faecalis*] | KYKCSWCKRVYTLRKDHRTAR | 1761 |
| gi\|58616111\|ref\|YP_195802.1\| | PcfP [*Enterococcus faecalis*] | WSEIEINTKQSN | 1762 |
| gi\|58616132\|ref\|YP_195769.1\| | PrgQ [*Enterococcus faecalis*] | MKTTLKKLSRYIAVVIAITLIFI | 1763 |
| gi\|58616137\|ref\|YP_195772.1\| | PrgT [*Enterococcus faecalis*] | HISKERFEAY | 1764 |
| gi\|6919848\|sp\|O33689.1\|CSP_STROR | Competence-stimulating peptide precursor (CSP) | DKRLPYFFKHLFSNRTK | 1765 |
| gi\|6919849\|sp\|O33666.1\|CSP2_STRMT | Competence-stimulating peptide precursor (CSP) | EMRKPDGALFNLFRRR | 1766 |
| gi\|6919850\|sp\|O33668.1\|CSP3_STRMT | Competence-stimulating peptide precursor (CSP) | EMRKSNNNFFHFLRRI | 1767 |
| gi\|6919851\|sp\|O33672.1\|CSP1_STRMT | Competence-stimulating peptide precursor (CSP) | ESRLPKIRFDFIFPRKK | 1768 |
| gi\|6919852\|sp\|O33675.1\|CSP4_STRMT | Competence-stimulating peptide precursor (CSP) | EIRQTHNIFFNFFKRR | 1769 |
| gi\|6919853\|sp\|O33690.1\|CSP2_STROR | Competence-stimulating peptide precursor (CSP) | DWRISETIRNLIFPRRK | 1770 |
| gi\|999344\|gb\|AAB34501.1\| | cOB1bacterial sex pheromone [*Enterococcus faecalis*, Peptide, 8 aa] | VAVLVLGA | 1771 |
| gi\|18307878\|gb\|AAL67734.1\|AF456136_2 | ComX pheromone precursor [*Bacillus subtilis*] | FFEDDKRKSFI | 1772 |
| gi\|18307882\|gb\|AAL67737.1\|AF456137_2 | ComX pheromone precursor [*Bacillus subtilis*] | FFEDDKRKSFI | 1773 |
| gi\|28272731\|emb\|CAD65660.1\| | accessory gene regulator protein D, peptide pheromone precursor [*Lactobacillus plantarum* WCFS1] | MKQKMYEAIAHLFKYVGAKQLVMCCVGIWFETKIPDELRK | 1774 |
| gi\|28379890\|ref\|NP_786782.1\| | accessory gene regulator protein D, peptide pheromone precursor [*Lactobacillus plantarum* WCFS1] | MKQKMYEAIAHLFKYVGAKQLVMCCVGIWFETKIPDELRK | 1775 |
| gi\|57489105\|gb\|AAW51312.1\| | PrgF [*Enterococcus faecalis*] | VVAYVITQVGAIRF | 1776 |
| gi\|58616090\|ref\|YP_195779.1\| | PrgF [*Enterococcus faecalis*] | VVAYVITQVGAIRF | 1777 |
| gi\|58616138\|ref\|YP_195762.1\| | PrgN [*Enterococcus faecalis*] | LLKLQDDYLLHLERHRRTKKIIDEN | 1778 |

TABLE 12-continued

Illustrative bacterial and fungal pheromones utilizable as targeting moieties.

| Locus tag | Product | Sequence | SEQ ID |
|---|---|---|---|
| gi\|57489117\|gb\|AAW51324.1\| | PcfF [*Enterococcus faecalis*] | EDIKDLTDKVQSLN ALVQSELNKLIKRK DQS | 1779 |
| gi\|57489119\|gb\|AAW51326.1\| | PcfH [*Enterococcus faecalis*] | WFLDFSDWLSKVP SKLWAE | 1780 |
| gi\|58616102\|ref\|YP_195792.1\| | PcfF [*Enterococcus faecalis*] | EDIKDLTDKVQSLN ALVQSELNKLIKRK DQS | 1781 |
| gi\|58616104\|ref\|YP_195794.1\| | PcfH [*Enterococcus faecalis*] | WFLDFSDWLSKVP SKLWAE | 1782 |
| Fungi | | | |
| gi\|1127585\|gb\|AAA99765.1\| | mfa1 gene product | MLSIFAQTTQTSAS EPQQSPTAPQGRDN GSPIGYSSCVVA | 1783 |
| gi\|1127592\|gb\|AAA99771.1\| | mfa2 gene product | MLSIFETVAAAAPV TVAETQQASNNEN RGQPGYYCLIA | 1784 |
| gi\|11907715\|gb\|AAG41298.1\| | pheromone precursor MFalpha1D [*Cryptococcus neoformans* var. *neoformans*] | PSLPSSPPSLLPPLPL LKLLATRRPTLVG MTLCV | 1785 |
| gi\|13810235\|emb\|CAC37424.1\| | M-factor precursor Mfm1 [*Schizosaccharomyces pombe*] | MDSMANSVSSSSV VNAGNKPAETLNK TVKNYTPKVPYMC VIA | 1786 |
| gi\|14269436\|gb\|AAK58071.1\|AF378295_1 | peptide mating pheromone precursor Bbp2-3 [*Schizophyllum commune*] | MDTFTYVDLAAVA AAAVADEVPRDFE DQITDYQSYCIIC | 1787 |
| gi\|14269440\|gb\|AAK58073.1\|AF378297_1 | peptide mating pheromone precursor Bbp2-1 [*Schizophyllum commune*] | SNVHGWCVVA | 1788 |
| gi\|1813600\|gb\|AAB41859.1\| | pheromone precursor Bbp1(1) [*Schizophyllum commune*] | NTTAHGWCVVA | 1789 |
| gi\|24940428\|emb\|CAD56313.1\| | a-pheromone [*Saccharomyces paradoxus*] | MQPSTVTAAPKDK TSAEKKDNYIIKGV FWDPACVIA | 1790 |
| gi\|27549492\|gb\|AAO17258.1\| | pheromone phb3.1 [*Coprinopsis cinerea*] | GPTWWCVNA | 1791 |
| gi\|27549494\|gb\|AAO17259.1\| | pheromone phb3.2 [*Coprinopsis cinerea*] | SGPTWFCIIQ | 1792 |
| gi\|27752314\|gb\|AAO19469.1\| | pheromone protein a pecursor [*Cryptococcus neoformans* var. *grubii*] | FTAIFSTLSSSVASK TDAPRNEEAYSSG NSP | 1793 |
| gi\|2865510\|gb\|AAC02682.1\| | MAT-1 pheromone [*Ustilago hordei*] | MFSIFAQPAQTSVS ETQESPANHGANP GKSGSGLGYSTCV VA | 1794 |
| gi\|3023372\|sp\|P78742.1\|BB11_SCHCO | RecName: Full = Mating-type pheromone BBP1(1); Flags: Precursor | NTTAHGWCVVA | 1795 |
| gi\|3025079\|sp\|P56508.1\|SNA2_YEAST | RecName: Full = Protein SNA2 | SDDNYGSLA | 1796 |
| gi\|37626077\|gb\|AAQ96360.1\| | pheromone precursor Phb3 B5 [*Coprinopsis cinerea*] | NGLTFWCVIA | 1797 |

TABLE 12-continued

Illustrative bacterial and fungal pheromones utilizable as targeting moieties.

| Locus tag | Product | Sequence | SEQ ID |
|---|---|---|---|
| gi|37626081|gb|AAQ96362.1| | pheromone precursor Phb3.2 B45 [Coprinopsis cinerea] | PSWFCVIA | 1798 |
| gi|37626083|gb|AAQ96363.1| | pheromone precursor Phb3.1 B47 [Coprinopsis cinerea] | ASWFCTIA | 1799 |
| gi|37961432|gb|AAP57503.1| | Ste3-like pheromone receptor [Thanatephorus cucumeris] | PHHKIANASDKRR RMYFEIFMCAVL | 1800 |
| gi|400250|sp|P31962.1|MFA1_USTMA | RecName: Full = A1-specific pheromone; AltName: Full = Mating factor A1 | MLSIFAQTTQTSAS EPQQSPTAPQGRDN GSPIGYSSCVVA | 1801 |
| gi|400251|sp|P31963.1|MFA2_USTMA | RecName: Full = A2-specific pheromone; AltName: Full = Mating factor A2 | MLSIFETVAAAAPV TVAETQQASNNEN RGQPGYYCLIA | 1802 |
| gi|41209131|gb|AAR99617.1| | lipopeptide mating pheromone precursor Bap2(3) [Schizophyllum commune] | SLTYAWCVVA | 1803 |
| gi|41209146|gb|AAR99650.1| | lipopeptide mating pheromone precursor Bap3(2) [Schizophyllum commune] | TSMAHAWCVVA | 1804 |
| gi|41209149|gb|AAR99653.1| | lipopeptide mating pheromone precursor Bbp2(8) [Schizophyllum commune] | GYCVVA | 1805 |
| gi|46098187|gb|EAK83420.1| | MFA1_USTMA A1-SPECIFIC PHEROMONE (MATING FACTOR A1) [Ustilago maydis 521] | MLSIFAQTTQTSAS EPQQSPTAPQGRDN GSPIGYSSCVVA | 1806 |
| gi|546861|gb|AAB30833.1| | M-factor mating pheromone [Schizosaccharomyces pombe] | MDSMANTVSSSVV NTGNKPSETLNKT VKNYTPKVPYMCV IA | 1807 |
| gi|5917793|gb|AAD56043.1|AF184069_1 | pheromone Mfa2 [Ustilago hordei] | MFSLFETVAAAVK VVSAAEPEHAPTNE GKGEPAPYCIIA | 1808 |
| gi|6014618|gb|AAF01424.1|AF186389_1 | Phb3.2.42 [Coprinus cinereus] | LTWFCVIA | 1809 |
| gi|68266363|gb|AAY88882.1| | putative pheromone receptor STE3.4 [Coprinellus disseminatus] | LREKRRRRWFEAF MGFGL | 1810 |
| gi|71012805|ref|XP_758529.1| | A1-specific pheromone [Ustilago maydis 521] | MLSIFAQTTQTSAS EPQQSPTAPQGRDN GSPIGYSSCVVA | 1811 |
| gi|72414834|emb|CAI59748.1| | mating factor a1.3 [Sporisorium reilianum] | MDALTLFAPVSLG AVATEQAPVDEER PNRQTFPWIGCVVA | 1812 |
| gi|72414854|emb|CAI59758.1| | mating factor a2.1 [Sporisorium reilianum] | MFIFESVVASVQAV SVAEQDQTPVSEG RGKPAVYCTIA | 1813 |
| gi|1127587|gb|AAA99767.1| | rba1 gene product | PWMSLLFSFLALLA LILPKLSKDDPLGL TRQPR | 1814 |

TABLE 12-continued

Illustrative bacterial and fungal pheromones utilizable as targeting moieties.

| Locus tag | Product | Sequence | SEQ ID |
|---|---|---|---|
| gi\|151941959\|gb\|EDN60315.1\| | pheromone-regulated membrane protein [Saccharomyces cerevisiae YJM789] | ASISLIMEGSANIEA VGKLVWLAAALPL AFI | 1815 |
| gi\|3025095\|sp\|Q07549.1\|SNA4_YEAST | Protein SNA4 | ARNVYPSVETPLLQ GAAPHDNKQSLVE SPPPYVP | 1816 |
| gi\|73921293\|sp\|Q08245.3\|ZEO1_YEAST | RecName: Full = Protein ZEO1; AltName: Full = Zeocin resistance protein 1 | FLKKLNRKIASIFN | 1817 |
| gi\|74644573\|sp\|Q9P305.3\|IGO2_YEAST EDF (E. coli) | RecName: Full = Protein IGO2 | DSISRQGSISSGPPP RSPNK | 1818 |
| | | NNWNN | 1819 | v. Targeting Enhancers/Opsonins

In certain embodiments compositions are contemplated that incorporate a targeting enhancer (e.g., an opsonin) along with one or more targeting moieties (e.g., targeting peptides). Targeting enhancers include moieties that increase binding affinity, and/or binding specificity, and/or internalization of a moiety by the target cell/microorganism.

Accordingly, in certain embodiments, a targeting moiety and/or a targeted antimicrobial molecule comprise a peptide, with the desired level of binding specificity and/or avidity, attached (e.g., conjugated) to an opsonin. When bound to a target cell through the targeting peptide, the opsonin component encourages phagocytosis and destruction by resident macrophages, dendritic cells, monocytes, or PMNs. Opsonins contemplated for conjugation can be of a direct or indirect type.

Direct opsonins include, fore example, any bacterial surface antigen, PAMP (pathogen-associated molecular pattern), or other molecule recognized by host PRRs (pathogen recognizing receptors). Opsonins can include, but are not limited to, bacterial protein, lipid, nucleic acid, charbohydrate and/or oligosaccharide moieties.

In certain embodiments opsonins include, but are not limited to, N-acetyl-D-glucosamine (GlcNAc), N-acetyl-D-galactosamine (GlaNAc), N-acetylglucosamine-containing muramyl peptides, NAG-muramyl peptides, NAG-NAM, peptidoglycan, teichoic acid, lipoteichoic acid, LPS, o-antigen, mannose, fucose, ManNAc, galactose, maltose, glucose, glucosamine, sucrose, mannosamine, galactose-alpha-1,3-galactosyl-beta-1,4-N-acetyl glucosamine, or alpha-1,3-gal-gal, or other sugars.

In certain embodiments, opsonins include indirect opsonins Indirect opsonins function through binding to a direct opsonin already present. For example an Fc portion of an antibody, a sugar-binding lectin protein (example MBL), or host complement factors (example C3b, C4b, iC3b).

In certain embodiments the opsonin is to galactose-alpha-1,3-galactosyl-beta-1,4-N-acetyl glucosamine, or alpha-1,3-gal-gal.

Other examples of opsonin molecules include, but are not limited to antibodies (e.g., IgG and IgA), components of the complement system (e.g., C3b, C4b, and iC3b), mannose-binding lectin (MBL) (initiates the formation of C3b), and the like.

Methods of coupling an opsonin to a targeting moiety are well known to those of skill in the art (see, e.g., discussion below regarding attachment of effectors to targeting moieties).

B) Effectors.

Any of a wide number of effectors can be coupled to targeting moieties as described herein to preferentially deliver the effector to a target organism and/or tissue. Illustrative effectors include, but are not limited to detectable labels, small molecule antibiotics, antimicrobial peptides, porphyrins or other photosensitizers, epitope tags/antibodies for use in a pretargeting protocol, agents that physically disrupt the extracellular matrix within a community of microorganisms, microparticles and/or microcapsules, nanoparticles and/or nanocapsules, "carrier" vehicles including, but not limited to lipids, liposomes, dendrimers, cholic acid-based peptide mimics or other peptide mimics, steroid antibiotics, and the like.

i. Detectable Labels.

In certain embodiments chimeric moieties are provided comprising a targeting moiety (e.g., as described in Table 3) attached directly or through a linker to a detectable label. Such chimeric moieties are effective for detecting the presence and/or quantity, and/or location of the microorganism(s) to which the targeting moiety is directed. Similarly these chimeric moieties are useful to identify cells and/or tissues and/or food stuffs and/or other compositions that are infected with the targeted microorganism(s).

Detectable labels suitable for use in such chimeric moieties include any composition detectable by spectroscopic, photochemical, biochemical, immunochemical, electrical, optical, or chemical means. Illustrative useful labels include, but are not limited to, biotin for staining with labeled streptavidin conjugates, avidin or streptavidin for labeling with biotin conjugates fluorescent dyes (e.g., fluorescein, texas red, rhodamine, green fluorescent protein, and the like, see, e.g., Molecular Probes, Eugene, Oreg., USA), radiolabels (e.g., $^{3}$H, $^{125}$I, $^{35}$S, $^{14}$C, $^{32}$P, $^{99}$Tc, $^{203}$Pb, $^{67}$Ga, $^{68}$Ga, $^{72}$As, $^{111}$In, $^{113m}$In, $^{97}$Ru, $^{62}$Cu, 641Cu, $^{52}$Fe, $^{52m}$Mn, $^{51}$Cr, $^{186}$Re, $^{188}$Re, $^{77}$As, $^{90}$Y, $^{67}$Cu, $^{169}$Er, $^{121}$Sn, $^{127}$Te, $^{142}$Pr, $^{143}$Pr, $^{198}$Au, $^{199}$Au, $^{161}$Tb, $^{109}$Pd, $^{165}$Dy, $^{149}$Pm, $^{151}$Pm, $^{153}$Sm, $^{157}$Gd, $^{159}$Gd, $^{166}$Ho, $^{172}$Tm, $^{169}$Yb, $^{175}$Yb, $^{177}$Lu, $^{105}$Rh, $^{111}$Ag, and the like), enzymes (e.g., horse radish peroxidase, alkaline phosphatase and others commonly used in an ELISA), various colorimetric labels, magnetic or paramagnetic labels (e.g., magnetic and/or paramagnetic nanoparticles), spin labels, radio-opaque labels, and the like. Patents teaching the use of such labels include, for example, U.S. Pat. Nos. 3,817,837; 3,850,752; 3,939,350; 3,996,345; 4,277,437; 4,275,149; and 4,366,241.

It will be recognized that fluorescent labels are not to be limited to single species organic molecules, but include inorganic molecules, multi-molecular mixtures of organic and/or inorganic molecules, crystals, heteropolymers, and the like. Thus, for example, CdSe-CdS core-shell nanocrystals enclosed in a silica shell can be easily derivatized for coupling to a biological molecule (Bruchez et al. (1998) *Science,* 281: 2013-2016). Similarly, highly fluorescent quantum dots (zinc sulfide-capped cadmium selenide) have been covalently coupled to biomolecules for use in ultrasensitive biological detection (Warren and Nie (1998) *Science,* 281: 2016-2018).

In various embodiments spin labels are provided by reporter molecules with an unpaired electron spin which can be detected by electron spin resonance (ESR) spectroscopy. Illustrative spin labels include organic free radicals, transitional metal complexes, particularly vanadium, copper, iron, and manganese, and the like. Exemplary spin labels include, for example, nitroxide free radicals.

Means of detecting such labels are well known to those of skill in the art. Thus, for example, where the label is a radioactive label, means for detection include a scintillation counter or photographic film as in autoradiography. Where the label is a fluorescent label, it may be detected by exciting the fluorochrome with the appropriate wavelength of light and detecting the resulting fluorescence, e.g., by microscopy, visual inspection, via photographic film, by the use of electronic detectors such as charge coupled devices (CCDs) or photomultipliers and the like. Similarly, enzymatic labels may be detected by providing appropriate substrates for the enzyme and detecting the resulting reaction product. Finally, simple colorimetric labels may be detected simply by observing the color associated with the label.

ii. Antibiotics.

In certain embodiments chimeric moieties are provided comprising a targeting moiety (e.g. as described in Table 3) attached directly or through a linker to a small molecule antibiotic and/or to a carrier (e.g., a lipid or liposome, a polymer, etc.) comprising a small molecule antibiotic. Illustrative antibiotics are shown in Table 13.

TABLE 13

Illustrative antibiotics for use in the chimeric moieties described herein.

| Class | Generic Name | BRAND NAME |
|---|---|---|
| Aminoglycosides | Amikacin | AMIKIN ® |
| | Gentamicin | GARAMYCIN ® |
| | Kanamycin | KANTREX ® |
| | Neomycin | |
| | Netilmicin | NETROMYCIN ® |
| | Streptomycin | |
| | Tobramycin | NEBCIN ® |
| | Paromomycin | HUMATIN ® |
| Carbacephem | Loracarbef | LORABID ® |
| Carbapenems | Ertapenem | INVANZ ® |
| | Doripenem | FINIBAX ® |
| | Imipenem/Cilastatin | PRIMAXIN ® |
| | Meropenem | MERREM ® |
| Cephalosporins (First generation) | Cefadroxil | DURICEF ® |
| | Cefazolin | ANCEF ® |
| | Cefalotin or Cefalothin | KEFLIN ® |
| | Cefalexin | KEFLEX ® |

TABLE 13-continued

Illustrative antibiotics for use in the chimeric moieties described herein.

| Class | Generic Name | BRAND NAME |
|---|---|---|
| Cephalosporins (Second generation) | Cefaclor | CECLOR ® |
| | Cefamandole | MANDOLE ® |
| | Cefoxitin | MEFOXIN ® |
| | Cefprozil | CEFZIL ® |
| | Cefuroxime | CEFTIN, ZINNAT ® |
| Cephalosporins (Third generation) | Cefixime | SUPRAX ® |
| | Cefdinir | OMNICEF ® |
| | Cefditoren | SPECTRACEF ® |
| | Cefoperazone | CEFOBID ® |
| | Cefotaxime | CLAFORAN ® |
| | Cefpodoxime | |
| | Ceftazidime | FORTAZ ® |
| | Ceftibuten | CEDAX ® |
| | Ceftizoxime | |
| | Ceftriaxone | ROCEPHIN ® |
| Cephalosporins (Fourth generation) | Cefepime | MAXIPIME ® |
| Cephalosporins (Fifth generation) | Ceftobiprole | |
| Glycopeptides | Teicoplanin | |
| | Vancomycin | VANCOCIN ® |
| Macrolides Azithromycin | Zithromax | |
| Clarithromycin | Biaxin | |
| Dirithromycin | | |
| Erythromycin | Erythocin, Erythroped | |
| Roxithromycin | | |
| Troleandomycin | | |
| Telithromycin | Ketek | |
| Monobactams | Aztreonam | |
| Penicillins | Amoxicillin | NOVAMOX ®, AMOXIL ® |
| | Ampicillin | |
| | Azlocillin | |
| | Carbenicillin | |
| | Cloxacillin | |
| | Dicloxacillin | |
| | Flucloxacillin | FLOXAPEN ® |
| | Mezlocillin | |
| | Meticillin | |
| | Nafcillin | |
| | Oxacillin | |
| | Penicillin | |
| | Piperacillin | |
| | Ticarcillin | |
| Polypeptides | Bacitracin | |
| | Colistin | |
| | Polymyxin B | |
| Quinolones | Mafenide | |
| | Prontosil (archaic) | |
| | Sulfacetamide | |
| | Sulfamethizole | |
| | Sulfanilimide (archaic) | |
| | Sulfasalazine | |
| | Sulfisoxazole | |
| | Trimethoprim | BACTRIM ® |
| | Trimethoprim-Sulfamethoxazole (Co-trimoxazole) (TMP-SMX) | |
| Tetracyclines | Demeclocycline | |
| | Doxycycline | VIBRAMYCIN ® |
| | Minocycline | MINOCIN ® |
| | Oxytetracycline | TERRACIN ® |
| | Tetracycline | SUMYCIN ® |
| Natural products | Antimicrobial herbal extracts | |
| | Essential oils | |
| | Farnesol | |
| | Licorice root extracts | |
| | Glycyrrhizol A | |
| | Glycyrrhizol B | |
| | 6,8-diisoprenyl-5,7,4'-trihydroxyisoflavone | |
| Others | Arsphenamine | SALVARSAN ® |
| | Chloramphenicol | CHLOROMYCETIN ® |

TABLE 13-continued

Illustrative antibiotics for use in the chimeric moieties described herein.

| Class | Generic Name | BRAND NAME |
|---|---|---|
|  | Clindamycin | CLEOCIN ® |
|  | Lincomycin |  |
|  | Ethambutol |  |
|  | Fosfomycin |  |
|  | Fusidic acid | FUCIDIN ® |
|  | Furazolidone |  |
|  | Isoniazid |  |
|  | Linezolid | ZYVOX ® |
|  | Metronidazole | FLAGYL ® |
|  | Mupirocin | BACTROBAN ® |
|  | Nitrofurantoin | MACRODANTIN ®, MACROBID ® |
|  | Platensimycin |  |
|  | Pyrazinamide |  |
|  | Quinupristin/Dalfopristin | SYNCERCID ® |
|  | Rifampin or Rifampicin |  |
|  | Tinidazole |  |
|  | Artemisinin |  |
| Antifungals | Amphotericin B |  |
|  | Anidulafungin |  |
|  | Caspofungin acetate |  |
|  | Clotrimazole |  |
|  | Fluconazole |  |
|  | Flucytosine |  |
|  | Griseofulvin |  |
|  | Itraconazole |  |
|  | Ketoconazole |  |
|  | Micafungin |  |
|  | Miconazole |  |
|  | Nystatin |  |
|  | Pentamidine |  |
|  | Posaconazole |  |
|  | Terbinafine |  |
|  | Voriconazole |  |
| Antimycobiotics | Aminosalicylic Acid |  |
|  | Capreomycin |  |
|  | Clofazimine |  |
|  | Cycloserine |  |
|  | Ethionamide |  |
|  | Rifabutin |  |
|  | Rifapentine |  |
| Antivirals | Abacavir |  |
|  | Acyclovir |  |
|  | Adefovir |  |
|  | Amantadine |  |
|  | Atazanavir |  |
|  | Cidofovir |  |
|  | Darunavir |  |
|  | Didanosine |  |
|  | Docosanol |  |
|  | Efavirenz |  |
|  | Emtricitabine |  |
|  | Enfuvirtide |  |
|  | Entecavir |  |
|  | Etravirine |  |
|  | Famciclovir |  |
|  | Fomivirsen |  |
|  | Fosamprenavir |  |
|  | Foscarnet |  |
|  | Ganciclovir |  |
|  | Idoxuridine |  |
|  | Indinavir |  |
|  | Interferon alpha |  |
|  | Lamivudine |  |
|  | Lopinavir/ritonavir |  |
|  | Maraviroc |  |
|  | Nelfinavir |  |
|  | Nevirapine |  |
|  | Oseltamivir |  |
|  | Penciclovir |  |
|  | Peramivir |  |
|  | Raltegravir |  |
|  | Ribavirin |  |
|  | Rimantadine |  |
|  | Ritonavir |  |
|  | Saquinavir |  |
|  | Stavudine |  |
|  | Telbivudine |  |
|  | Tenofovir |  |
|  | Tipranavir |  |
|  | Trifluridine |  |
|  | Valacyclovir |  |
|  | Valganciclovir |  |
|  | Zanamivir |  |
|  | Zidovudine |  |
| Anti-parasitics | Albendazole |  |
|  | Artesunate |  |
|  | Atovaquone |  |
|  | Bephenium hydroxynaphthoate |  |
|  | Chloroquine |  |
|  | Dapsone |  |
|  | Diethyl-carbamazine |  |
|  | Diloxanide furoate |  |
|  | Eflornithine |  |
|  | Emetine HCl |  |
|  | Furazolidone |  |
|  | Ivermectin |  |
|  | Lindane |  |
|  | Mebendazole |  |
|  | Mefloquine |  |
|  | Melarsoprol |  |
|  | Miltefosine |  |
|  | Niclosamide |  |
|  | Nifurtimox |  |
|  | Nitazoxanide |  |
|  | Oxamniquine |  |
|  | Paromomycin |  |
|  | Permethrin |  |
|  | Piperazine |  |
|  | Praziquantel |  |
|  | Primaquine |  |
|  | Pyrantel pamoate |  |
|  | Pyrimethamine |  |
|  | Proguanil |  |
|  | Quinacrine HCl |  |
|  | Quinidine |  |
|  | Quinine |  |
|  | Sodium Stibogluconate |  |
|  | Spiramycin |  |
|  | Thiabendazole |  |
|  | Tinidazole |  | iii. Porphyrins and Non-Porphyrin Photosensitizers.

In certain embodiments, porphyrins and other photosensitizers can be used as targeting moieties and/or as effectors in the methods and compositions of this invention. A photosensitizer is a drug or other chemical that increases photosensitivity of the organism (e.g., bacterium, yeast, fungus, etc.). As targeting moieties the photosensitizers (e.g., porphyrins) are preferentially uptaken by the target microorganisms and thereby facilitate delivery of the chimeric moiety to the target microorganism.

As effectors, photosensitizers can be useful in photodynamic antimicrobial chemotherapy (PACT). In various embodiments PACT utilizes photosensitizers and light (e.g., visible, ultraviolet, infrared, etc.) in order to give a phototoxic response in the target organism(s), often via oxidative damage.

Currently, the major use of PACT is in the disinfection of blood products, particularly for viral inactivation, although more clinically-based protocols are used, e.g. in the treatment of oral infection or topical infection. The technique has been shown to be effective in vitro against bacteria (including drug-resistant strains), yeasts, viruses, parasites, and the like.

Attaching a targeting moiety (e.g., a targeting peptide) to the photosensitizer, e.g., as described herein, provides a means of specifically or preferentially targeting the photosensitizer(s) to particular species or strains(s) of microorganism.

A wide range of photosensitizers, both natural and synthetic are known to those of skill in the art (see, e.g., Wainwright (1998) *J. Antimicrob. Chemotherap.* 42: 13-28). Photosensitizers are available with differing physicochemical make-up and light-absorption properties. In various embodiments photosensitizers are usually aromatic molecules that are efficient in the formation of long-lived triplet excited states. In terms of the energy absorbed by the aromatic-system, this again depends on the molecular structure involved. For example: furocoumarin photosensitizers (psoralens) absorb relatively high energy ultraviolet (UV) light (c. 300-350 nm), whereas macrocyclic, heteroaromatic molecules such as the phthalocyanines absorb lower energy, near-infrared light.

Illustrative photosensitizers include, but are not limited to porphyrinic macrocyles (especially porphyrins, chlorines, etc., see, e.g., FIGS. 1 and 2). In particular, metalloporphyrins, particularly a number of non-iron metalloporphyrins mimic haem in their molecular structure and are actively accumulated by bacteria via high affinity haem-uptake systems. The same uptake systems can be used to deliver antibiotic-porphyrin and antibacterial-porphyrin conjugates. Illustrative targeting porphyrins suitable for this purpose are described in U.S. Pat. No. 6,066,628 and shown herein in FIGS. 1 and 2.

Figure 13:
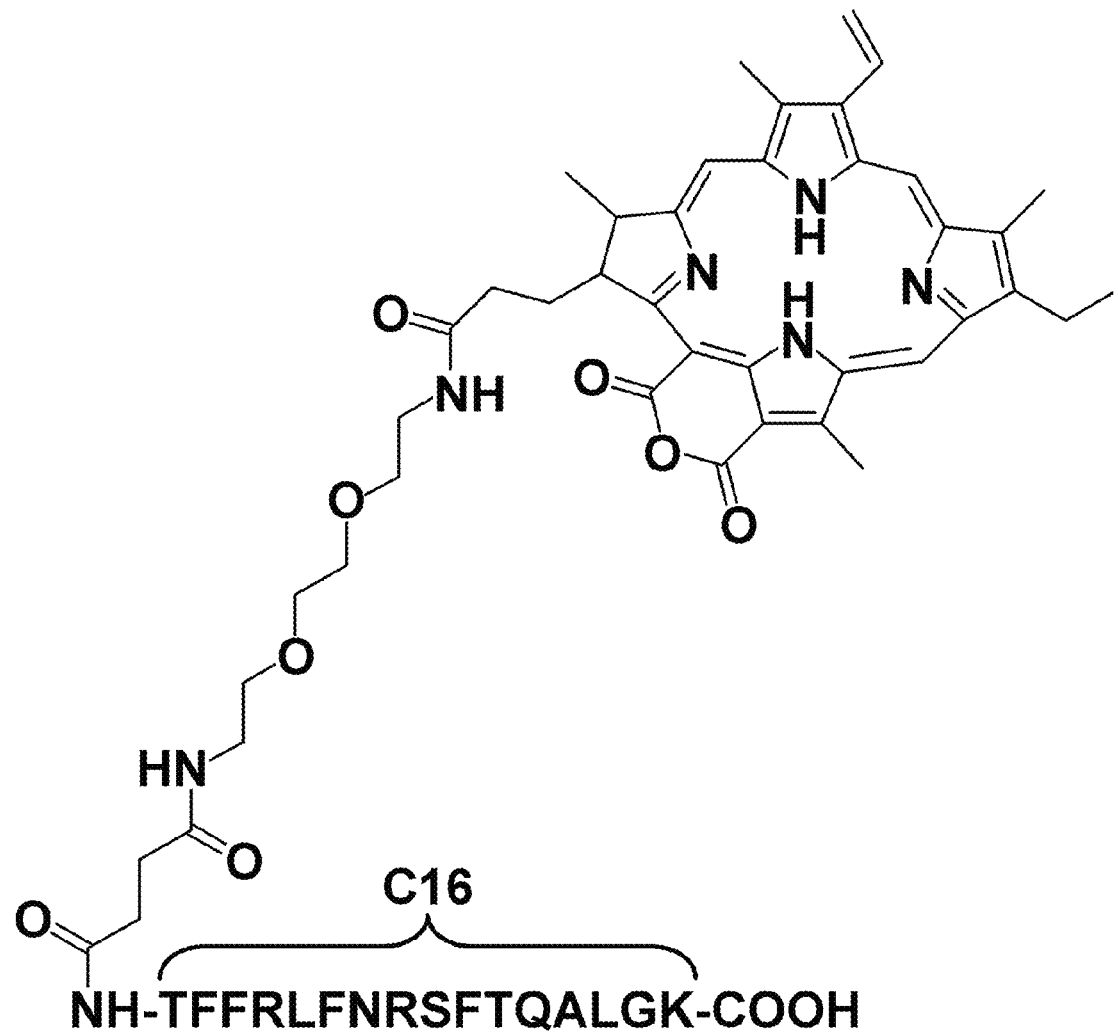
FIG. 13 illustrates an example of a targeted light-activated porphyrin we have constructed: C16-P18 comprising a porphyrin coupled to a C16 (SEQ ID NO:3) targeting sequence.

Illustrative examples of targeted porphyrins are described in Example 5 and associated figures and in FIG. 13.

For example, certain artificial (non-iron) metalloporphyrins (MPs) (Ga—IX, Mn—IX), are active against Gram-negative and Gram-positive bacteria and acid-fast bacilli (e.g., *Y. enterocolitica, N. meningitides, S. marcescens, E. coli, P. mirabills, K. pneumoniae, K. oxytoca, Ps. aeruginosa, C. freundii, E. aerogenes, F. menigosepticum, S. aureus, B. subtilis, S. pyogenes A, E. faecalis, M. smegmatis, M. bovis, M tuber., S. crevisiae*) as described in Tables 1-5 of U.S. Pat. No. 6,066,628. These MPs can be used as targeting moieties against these microorganisms.

Similarly, some MPs are also growth-inhibitory against yeasts, indicating their usefulness targeting moieties to target *Candida* species (e.g., *Candida albicans, C. krusei, C. pillosus, C. glabrata*, etc.) and other mycoses including but not limited to those caused by as *Trichophyton, Epidermophyton, Histoplasma, Aspergillus, Cryptococcus,* and the like.

Other photosensitizers include, but are not limited to cyanines (see, e.g., FIG. 6) and phthalocyanines (see, e.g., FIG. 4), azines (see, e.g., FIG. 5) including especially methylene blue and touidine blue, hypericin (see, e.g., FIG. 8), acridines (see, e.g., FIG. 9) including especially Rose Bengal (see, e.g., FIG. 10), crown ethers (see, e.g., FIG. 11), and the like. In certain embodiments, the photosensitizers include tin chlorin 6 and related compounds (e.g., other chlorines and tin porphyrins).

Figure 12:
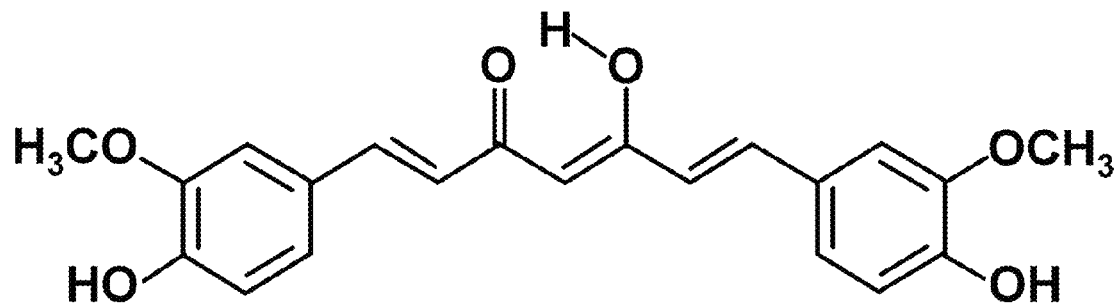
FIG. 12 illustrates the structure of cumin.

Another light-activated compound is cucumin (see, FIG. 12).

In certain embodiments the photosensitizers are toxic or growth inhibitors without light activation. For example, some non-iron metalloporphyrins (MPs) (see, e.g., FIGS. 1 and 2 herein) possess a powerful light-independent antimicrobial activity. In addition, haemin, the most well known natural porphyrin, possesses a significant antibacterial activity that can augmented by the presence of physiological concentrations of hydrogen peroxide or a reducing agent.

Typically, when activated by light, the toxicity or growth inhibition effect is substantially increased. Typically, they generate radical species that affect anything within proximity. In certain embodiments to get the best selectivity from targeted photosensitizers, anti-oxidants can be used to quench un-bound photosensitizers, limiting the damage only to cells where the conjugates have accumulated due to the targeting peptide. The membrane structures of the target cell act as the proton donors in this case.

In typical photodynamic antimicrobial chemotherapy (PACT) the targeted photosensitizer is "activated by the application of a light source (e.g., a visible light source, an ultraviolate light source, an infrared light source, etc.). PACT applications however need not be limited to topical use. Regions of the mouth, throat, nose, sinuses are readily illuminated. Similarly regions of the gut can readily be illuminated using endoscopic techniques. Other internal regions can be illumined using laparoscopic methods or during other surgical procedures. For example, in certain embodiments involving the insertion or repair or replacement of an implantable device (e.g., a prosthetic device) it contemplated that the device can be coated or otherwise contacted with a chimeric moiety comprising a targeting moiety attached to a photosensitizer as described herein. During the surgical procedure and/or just before closing, the device can be illuminated with an appropriate light source to activate the photosensitizer.

The targeted photosensitizers and uses thereof described herein are illustrative and not to be limiting. Using the teachings provided herein, other targeted photosensitizers and uses thereof will be available to one of skill in the art.

iv. Antimicrobial Peptides.

In certain embodiments, the effector can comprise one or more antimicrobial peptides or compound antimicrobial peptides, e.g., as described above. Numerous antimicrobial peptides are well known to those of skill in the art.

In certain embodiments the antimicrobial peptides comprise one or more amino acid sequences described above (e.g., one or more domains comprising amino acid sequences in Tables 4 and/or 5) and/or one or more of the amino acid sequences shown in Table 14. In certain embodiments the antimicrobial peptides comprise one or more amino acid sequences described in the "Collection of Anti-Microbial Peptides" (CAMP) an online database developed for advancement the understanding of antimicrobial peptides (see, e.g., Thomas et al. (2009) Nucleic Acids Research, 2009, 1-7.doi:10.1093/nar/gkp1021) available at www.bicnirrh.res.in/antimicrobial.

TABLE 14

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00274 | 1BH4, Circulin A (CirA, plant cyclotides, XXC, ZZHp) | GIPCGESCVWIPCISAALGCSCKNK VCYRN | 1820 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00036 | 1BNB, Beta-defensin 1 (cow) | DFASCHTNGGICLPNRCPGHMIQIG ICFRPRVKCCRSW | 1821 |
| AP00047 | 1BNB, Bovine neutrophil beta-defensin 12 (BNBD-12, cow) | GPLSCGRNGGVCIPIRCPVPMRQIG TCFGRPVKCCRSW | 1822 |
| AP00428 | 1C01, MiAMP1 (*Macadamia integrifolia* antimicrobial peptide 1, plant) | SAFTVWSGPGCNNRAERYSKCGCS AIHQKGGYDFSYTGQTAALYNQA GCSGVAHTRFGSSARACNPFGWKS IFIQC | 1823 |
| AP00154 | 1CIX, Tachystatin A2 (Horseshoe crabs, Crustacea, BBS) | YSRCQLQGFNCVVRSYGLPTIPCC RGLTCRSYFPGSTYGRCQRY | 1824 |
| AP00145 | 1CW5, Carnobacteriocin B2 (CnbB2, class IIA bacteriocin, bacteria) | VNYGNGVSCSKTKCSVNWGQAFQ ERYTAGINSFVSGVASGAGSIGRRP | 1825 |
| AP00153 | 1CZ6, Androctonin (scorpions) | RSVCRQIKICRRRGGCYYKCTNRPY | 1826 |
| AP00152 | 1D6X, Tritrpticin (synthetic) | VRRFPWWWPFLRR | 1827 |
| AP00201 | 1D7N, Mastoparan (insect) | INLKALAALAKKIL | 1828 |
| AP00140 | 1D9J, CecropinA-Magainin2 hybrid (synthetic) | KWKLFKKIGIGKFLHSAKKF | 1829 |
| AP00178 | 1DFN, human alpha Defensin HNP-3 (human neutrophil peptide-3, HNP3, human defensin, ZZHh) | DCYCRIPACIAGERRYGTCIYQGRL WAFCC | 1830 |
| AP01153 | 1DQC, Tachycitin (horseshoe crabs, Crustacea, BBS) | YLAFRCGRYSPCLDDGPNVNLYSC CSFYNCHKCLARLENCPKGLHYN AYLKVCDWPSKAGCT | 1831 |
| AP00437 | 1DUM, Magainin 2 analog (synthetic) | GIGKYLHSAKKFGKAWVGEIMNS | 1832 |
| AP00451 | 1E4S, Human beta defensin 1 (HBD-1, human defensin) | DHYNCVSSGGQCLYSACPIFTKIQG TCYRGKAKCCK | 1833 |
| AP00149 | 1EWS, Rabbit kidney defensin 1 (RK-1) | MPCSCKKYCDPWEVIDGSCGLFNS KYICCREK | 1834 |
| AP00141 | 1F0E, CecropinA-Magainin2 Hybrid (P18, synthetic) | KWKLFKKIPKFLHSAKKF | 1835 |
| AP00142 | 1F0G, CecropinA-Magainin2 Hybrid (synthetic) | KLKLFKKIGIGKFLHSAKKF | 1836 |
| AP00143 | 1F0H, CecropinA-Magainin2 Hybrid (synthetic) | KAKLFKKIGIGKFLHSAKKF | 1837 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00524 | 1FD4, Human beta defensin 2 (HBD-2, human defensin, ZZHh) | GIGDPVTCLKSGAICHPVFCPRRYK QIGTCGLPGTKCCKKP | 1838 |
| AP00438 | 1FJN, Mussel Defensin MGD-1 | GFGCPNNYQCHRHCKSIPGRCGGY CGGWHRLPCTCYRCG | 1839 |
| AP00155 | 1FRY, SMAP-29 (SMAP29, sheep cathelicidin) | RGLRRLGRKIAHGVKKYGPTVLRII RIAG | 1840 |
| AP00150 | 1G89, Indolicidin (cow cathelicidin, BBN, ZZHa) | ILPWKWPWWPWRR | 1841 |
| AP00156 | 1GR4, Microcin J25, linear (MccJ25, bacteriocin, bacteria) | VGIGTPISFYGGGAGHVPEYF | 1842 |
| AP00151 | 1HR1, Indolicidin P to A mutant (synthetic) | ILAWKWAWWAWRR | 1843 |
| AP00196 | 1HU5, Ovispirin-1 (synthetic) | KNLRRIIRKIIHIIKKYG | 1844 |
| AP00197 | 1HU6, Novispirin G10 (synthetic) | KNLRRIIRKGIHIIKKYG | 1845 |
| AP00198 | 1HU7, Novispirin T7 (synthetic) | KNLRRITRKIIHIIKKYG | 1846 |
| AP00445 | 1HVZ, Monkey RTD-1 (rhesus theta-defensin-1, minidefensin-1, animal defensin, XXC, BBS, lectin, ZZHa) | GFCRCLCRRGVCRCICTR | 1847 |
| AP00103 | 1i2v, Heliomicin variant (Hel-LL, synthetic) | DKLIGSCVWGAVNYTSDCNGECL LRGYKGGHCGSFANVNCWCET | 1848 |
| AP00216 | 1ICA, *Phormia* defensin A (insect defensin A) | ATCDLLSGTGINHSACAAHCLLRG NRGGYCNGKGVCVCRN | 1849 |
| AP01224 | 1Jo3, Gramicidin B (bacteria) | VGALAVVVWLFLWLW | 1850 |
| AP01225 | 1jo4, Gramicidin C (bacteria) | VGALAVVVWLYLWLW | 1851 |
| AP00191 | 1KFP, Gomesin (Gm, Spider, XXA) | ECRRLCYKQRCVTYCRGR | 1852 |
| AP00283 | 1KJ6, Huamn beta defensin 3 (HBD-3, human defensin, ZZHh) | GIINTLQKYYCRVGGRCAVLSCL PKEEQIGKCSTRGRKCCRRKK | 1853 |
| AP00147 | 1KV4, Moricin (insect, silk moth) | AKIPIKAIKTVGKAVGKGLRAINIA STANDVFNFLKPKKRKA | 1854 |
| AP00227 | 1L4V, Sapecin (insect, flesh fly) | ATCDLLSGTGINHSACAAHCLLRG NRGGYCNGKAVCVCRN | 1855 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP01161 | 1L9L, Human granulysin (huGran) | GRDYRTCLTIVQKLKKMVDKPTQ RSVSNAATRVCTRGRSRWRDVCR NFMRRYQSRVIQGLVAGETAQQIC EDLRLCIPSTGPL | 1856 |
| AP00026 | 1LFC, Lactoferricin B (LfcinB, cow, ZZHa) | FKCRRWQWRMKKLGAPSITCVRR AF | 1857 |
| AP00193 | 1M4F, human LEAP-1 (Hepcidin 25) | DTHFPICIFCCGCCHRSKCGMCCKT | 1858 |
| AP00499 | 1MAG, Gramicidin A (gA, bacteria) | VGALAVVVWLWLWLW | 1859 |
| AP00403 | 1MM0, Termicin (termite defensin, insect defensin) | ACNFQSCWATCQAQHSIYFRRAFC DRSQCKCVFVRG | 1860 |
| AP00194 | 1MMC, Ac-AMP2 (plant defensin, BBS) | VGECVRGRCPSGMCCSQFGYCGK GPKYCGR | 1861 |
| AP01206 | 1MQZ, Mersacidin (bacteria) | CTFTLPGGGGVCTLTSECIC | 1862 |
| AP00429 | 1NKL, Porcine NK-Lysin (pig) | GYFCESCRKIIQKLEDMVGPQPNE DTVTQAASQVCDKLKILRGLCKKI MRSFLRRISWDILTGKKPQAICVDI KICKE | 1863 |
| AP00633 | 1og7, Sakacin P/ Sakacin 674 (SakP, class IIA bacteriocin, bacteria) | KYYGNGVHCGKHSCTVDWGTAIG NIGNNAAANWATGGNAGWNK | 1864 |
| AP00195 | 1PG1, Protegrin 1 (Protegrin-1, PG-1, pig cathelicidin, XXA, ZZHa, BBBm) | RGGRLCYCRRRFCVCVGR | 1865 |
| AP00928 | 1PXQ, Subtilosin A (XXC, class I bacteriocin, Gram-positive bacteria) | NKGCATCSIGAACLVDGPIPDFEIA GATGLFGLWG | 1866 |
| AP00480 | 1Q71, Microcin J25 (cyclic McCJ25, class I microcins, bacteriocins, Gram-negative bacteria, XXC; BBP) | VGIGTPIFSYGGGAGHVPEYF | 1867 |
| AP00211 | 1RKK, Polyphemusin I (crabs, Crustacea) | RRWCFRVCYRGFCYRKCR | 1868 |
| AP00430 | 1T51, IsCT (Scorpion) | ILGKIWEGIKSLF | 1869 |
| AP00731 | 1ut3, Spheniscin-2 (Sphe-2, penguin defensin, avian defensin) | SFGLCRLRRGFCARGRCRFPSIPIGR CSRFVQCCRRVW | 1870 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00013 | 1VM5, Aurein 1.2 (frog) | GLFDIIKKIAESF | 1871 |
| AP00214 | 1WO1, Tachyplesin I (crabs, Crustacea, XXA, ZZHa) | KWCFRVCYRGICYRRCR | 1872 |
| AP00644 | 1xc0, Pardaxin 4 (Pardaxin P-4, Pardaxin P4, Pa4, flat fish) | GFFALIPKIISSPLFKTLLSAVGSALS SSGGQE | 1873 |
| AP00493 | 1XKM, Distinctin (two chains for stability and transport? frog) | NLVSGLIEARKYLEQLHRKLKNCKV | 1874 |
| AP00420 | 1XV3, Penaeidin-4d (penaeidin 4, shrimp, Crustacea) | HSSGYTRPLRKPSRPIFIRPIGCDVC YGIPSSTARLCCFRYGDCCHL | 1875 |
| AP00035 | 1YTR, Plantaricin A (PlnA, bacteriocin, bacteria) | KSSAYSLQMGATAIKQVKKLFKK WGW | 1876 |
| AP00166 | 1Z64, Pleurocidin (fish) | GWGSFFKKAAHVGKHVGKAALT HYL | 1877 |
| AP00780 | 1Z6V, Human lactoferricin | GRRRRSVQWCAVSQPEATKCFQW QRNMRKVRGPPVSCIKRDSPIQCIQA | 1878 |
| AP00549 | 1ZFU, Plectasin (fungi, fungal defensin) | GFGCNGPWDEDDMQCHNHCKSIK GYKGGYCAKGGFVCKCY | 1879 |
| AP00177 | 1ZMH, human alpha Defensin HNP-2 (human neutrophil peptide-2, HNP2, human defensin, ZZHh) | CYCRIPACIAGERRYGTCIYQGRL WAFCC | 1880 |
| AP00179 | 1ZMM, human alpha Defensin HNP-4 (human neutrophil peptide-4, HNP4, human defensin) | VCSCRLVFCRRTELRVGNCLIGGV SFTYCCTRVD | 1881 |
| AP00180 | 1ZMP, human alpha Defensin HD-5 (HD5, human defensin) | QARATCYCRTGRCATRESLSGVCE ISGRLYRLCCR | 1882 |
| AP00181 | 1ZMQ, human alpha Defensin HD-6 (HD6, human defensin) | STRAFTCHCRRSCYSTEYSYGTCT VMGINHRFCCL | 1883 |
| AP00399 | 1ZRW, Spinigerin (insect, termite) | HVDKKVADKVLLLKQLRIMRLLT RL | 1884 |
| AP01157 | 1ZRX, Stomoxyn (insect) | RGFRKHFNKLVKKVKHTISETAHV AKDTAVIAGSGAAVVAAT | 1885 |
| AP00637 | 2A2B, Curvacin A/ sakacin A (CurA, | ARSYGNGVYCNNKKCWVNRGEA TQSIIGGMISGWASGLAGM | 1886 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| | SakA, class IIA bacteriocin, bacteria) | | |
| AP00558 | 2B68, Cg-Def (*Crassostrea gigas* defensin, oyster defensin, animal defensin) | GFGCPGNQLKCNNHCKSISCRAGY CDAATLWLRCTCTDCNGKK | 1887 |
| AP01154 | 2B9K, LCI (bacteria) | AIKLVQSPNGNFAASFVLDGTKWI FKSKYYDSSKGYWVGIYEVWDRK | 1888 |
| AP01005 | 2DCV, Tachystatin B1 (BBS, horseshoe crabs) | YVSCLFRGARCRVYSGRSCCFGYY CRRDFPGSIFGTCSRRNF | 1889 |
| AP01006 | 2DCW, Tachystatin B1 (BBS, horseshoe crabs) | YITCLFRGARCRVYSGRSCCFGYY CRRDFPGSIFGTCSRRNF | 1890 |
| AP00275 | 2ERI, Circulin B (CirB, plant cyclotides, XXC, ZZHp) | CGESCVFIPCISTLLGCSCKNKVCY RNGVIP | 1891 |
| AP00707 | 2f3a, LLAA (LL-37-derived aurein 1.2 analog, retro-FK13, synthetic) | RLFDKIRQVIRKF | 1892 |
| AP00708 | 2fbs, FK-13 (FK13, NMR-discovered LL-37 core peptide, XXA, ZZHs, synthetic) | FKRIVQRIKDFLR | 1893 |
| AP00088 | 2G9L, Gaegurin-4 (Gaegurin 4, frog) | GILDTLKQFAKGVGKDLVKGAAQ GVLSTVSCKLAKTC | 1894 |
| AP01011 | 2G9P, Latarcin 2a (Ltc2a, BBM, spider) | GLFGKLIKKFGRKAISYAVKKARG KH | 1895 |
| AP00612 | 2GDL, Fowlicidin-2 (chCATH-2, bird cathelicidin, chicken cathelicidin, BBL) | LVQRGRFGRFLRKIRRFRPKVTITI QGSARFG | 1896 |
| AP00402 | 2GL1, VrD2 (*Vigna radiata* defensin 2, plant defensin, mung bean) | KTCENLANTYRGPCFTTGSCDDHC KNKEHLRSGRCRDDFRCWCTRNC | 1897 |
| AP00285 | 2GW9, Cryptdin-4 (Crp4, animal defensin, alpha, mouse) | GLLCYCRKGHCKRGERVRGTCGIR FLYCCPRR | 1898 |
| AP00613 | 2hfr, Fowlicidin-3 (chCATH-3, bird cathelicidin, chicken cathelicidin) | RVKRFWPLVPVAINTVAAGINLYK AIRRK | 1899 |
| AP01007 | 2JMY, CM15 (Synthetic) | KWKLFKKIGAVLKVL | 1900 |

TABLE 14-continued

Other illustrative antimicrobial peptides. AP numbers refer to ID in antimicrobial peptide database (http://aps.unmc.edu/AP/main.php).

| Effector | | Structure/Sequence | SEQ ID No |
|---|---|---|---|
| AP00728 | 2jni, Arenicin-2 (marine polychaeta, BBBm) | RWCVYAYVRIRGVLVRYRRCW | 1901 |
| AP00473 | 2jos, Piscidin 1 (fish) | FFHHIFRGIVHVGKTIHRLVTG | 1902 |
| AP01151 | 2JPJ, Lactococcin G-a (chain a, class IIb bacteriocin, bacteria. For chain b, see info) | GTWDDIGQGIGRVAYWVGKALGN LSDVNQASRINRKKKH | 1903 |
| AP00757 | 2jpy, Phylloseptin-H2 (PLS-H2, Phylloseptin-2, PS-2) (XXA, frog) | FLSLIPHAINAVSTLVHHF | 1904 |
| AP00546 | 2jq0, Phylloseptin-1 (Phylloseptin-H1, PLS-H1, PS-1, XXA, frog) | FLSLIPHAINAVSAIAKHN | 1905 |
| AP00758 | 2jq1, Phylloseptin-3 (Phylloseptin-H3, PLS-H3, PS-3) (XXA, frog) | FLSLIPHAINAVSALANHG | 1906 |
| AP00727 | 2jsb, Arenicin-1 (marine polychaeta, BBBm) | RWCVYAYVRVRGVLVRYRRCW | 1907 |
| AP00592 | 2k10, Ranatuerin-2CSa (frog) | GILSSFKGVAKGVAKDLAGKLLET LKCKITGC | 1908 |
| AP00485 | 2K38, Cupiennin 1a (spider) | GFGALFKFLAKKVAKTVAKQAAK QGAKYVVNKQME | 1909 |
| AP00310 | 2K6O, Human LL-37 (LL37, human cathelicidin; released by proteinase 3 from its precursor in neutrophils; FALL-39; BBB, BBM, BBP, BBW, BBD, BBL, ZZHh) | LLGDFFRKSKEKIGKEFKRIVQRIK DFLRNLVPRTES | 1910 |
| AP00199 | 2LEU, Leucocin A (LeuA, class IIa bacteriocin, bacteria) | KYYGNGVHCTKSGCSVNWGEAFS AGVHRLANGGNGFW | 1911 |
| AP00144 | 2MAG, Magainin 2 (frog) | GIGKFLHSAKKFGKAFVGEIMNS | 1912 |
| AP00146 | 2MLT, Melittin (insect, ZZHa) | GIGAVLKVLTTGLPALISWIKRKRQQ | 1913 |
| AP01010 | 2PCO, Latarcin 1 (Ltc1, BBM, spider) | SMWSGMWRRKLKKLRNALKKKL KGEK | 1914 |
| AP00176 | 2PM1, human alpha Defensin HNP-1 (human neutrophil peptide-1, HNP1, human defensin, ZZHh) | ACYCRIPACIAGERRYGTCIYQGRL WAFCC | 1915 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP01158 | 2RLG, RP-1 (synthetic) | ALYKKFKKKLLKSLKRL | 1916 |
| AP00102 | 8TFV, Thanatin (insect) | GSKKPVPIIYCNRRTGKCQRM | 1917 |
| AP00995 | A58718, Carnocin UI49 (bacteria) | GSEIQPR | 1918 |
| AP01002 | AAC18827, Mutacin III (mutacin 1140, bacteria) | KSWSLCTPGCARTGSFNSYCC | 1919 |
| AP00987 | ABI74601, Arasin 1 (Crustacea) | SRWPSPGRPRPFPGRPKPIFRPRPCNCYAPPCPCDRW | 1920 |
| AP01000 | CAA63706, variacin (lantibiotic, class I bacteriocin, bacteria) | GSGVIPTISHECHMNSFQFVFTCCS | 1921 |
| AP00361 | O15946, Lebocin 4 (insect, silk moth) | DLRFWNPREKLPLPTLPPFNPKPIYIDMGNRY | 1922 |
| AP00343 | O16825, Andropin (insect, fruit fly) | VFIDILDKMENAIHKAAQAGIGIAKPIEKMILPK | 1923 |
| AP00417 | O17513, Ceratotoxin D (insect, fly) | SIGTAVKKAVPIAKKVGKVAIPIAKAVLSVVGQLVG | 1924 |
| AP00435 | O18494, Styelin C (sea squirt, tunicate, XXA) | GWFGKAFRSVSNFYKKHKTYIHAGLSAATLL | 1925 |
| AP00330 | O18495, Styelin D (Sea squirt, tunicate, XXA) | GWLRKAAKSVGKFYYKHKYYIKAAWQIGKHAL | 1926 |
| AP00331 | O18495, Styelin E (Sea squirt, tunicate, XXA) | GWLRKAAKSVGKFYYKHKYYIKAAWKIGRHAL | 1927 |
| AP01001 | O54329, Mutacin II (lantibiotic, mutacin H-29B, J-T8, class I bacteriocin, bacteria) | NRWWQGVVPTVSYECRMNSWQHVFTCC | 1928 |
| AP00342 | O81338, Antimicrobial peptide 1 (plant) | AKCIKNGKGCREDQGPPFCCSGFCYRQVGWARGYCKNR | 1929 |
| AP00373 | O96059, Moricin 2 (insect) | AKIPIKAIKTVGKAVGKGLRAINIASTANDVFNFLKPKKRKH | 1930 |
| AP00449 | P01190, Melanotropin alpha (Alpha-MSH) | SYSMEHFRWGKPV | 1931 |
| AP00187 | P01376, CORTICOSTATIN III (MCP-1, rabbit neutrophil peptide 1, NP-1) (animal defensin, alpha-defensin, rabbit) | VVCACRRALCLPRERRAGFCRIRGRIHPLCCRR | 1932 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00188 | P01377, CORTICOSTATIN IV (MCP-2, rabbit neutrophil defensin 2, NP-2, animal defensin, rabbit) | VVCACRRALCLPLERRAGFCRIRG RIHPLCCRR | 1933 |
| AP00049 | P01505, Bombinin (toad) | GIGALSAKGALKGLAKGLAEHFAN | 1934 |
| AP00139 | P01507, Cecropin A (insect, ZZHa) | KWKLFKKIEKVGQNIRDGIIKAGP AVAVVGQATQIAK | 1935 |
| AP00128 | P01509, Cecropin B (insect, silk moth) | KWKIFKKIEKVGRNIRNGIIKAGPA VAVLGEAKAL | 1936 |
| AP00131 | P01511, Cecropin D (insect, moth) | WNPFKELERAGQRVRDAIISAGPA VATVAQATALAK | 1937 |
| AP00136 | P01518, Crabrolin (insect, XXA) | FLPLILRKIVTAL | 1938 |
| AP00183 | P04142, Cecropin B (insect) | RWKIFKKIEKMGRNIRDGIVKAGP AIEVLGSAKAI | 1939 |
| AP00448 | P04205, Mastoparan M (MP-M, insect, XXA) | INLKAIAALAKKLL | 1940 |
| AP00234 | P06833, Seminalplasmin (SPLN, calcium transporter inhibitor, caltrin, cow) | SDEKASPDKHHRFSLSRYAKLANR LANPKLLETFLSKWIGDRGNRSV | 1941 |
| AP00314 | P07466, Rabbit neutrophil peptide 5 (NP-5, animal defensin, alpha-defensin) | VFCTCRGFLCGSGERASGSCTINGV RHTLCCRR | 1942 |
| AP00189 | P07467, Rabbit neutrophil peptide 4 (NP-4) | VSCTCRRFSCGFGERASGSCTVNG VRHTLCCRR | 1943 |
| AP00186 | P07468, CORTICOSTATIN II (Rabbit neutrophil peptide 3b (NP-3b, rabbit) | GRCVCRKQLLCSYRERRIGDCKIR GVRFPFCCPR | 1944 |
| AP00185 | P07469, CORTICOSTATIN I (rabbit) | ICACRRRFCPNSERFSGYCRVNGA RYVRCCSRR | 1945 |
| AP00217 | P07469, Rabbit neutrophil defensin 3a (NP-3a, animal defensin, alpha-defensin) | GICACRRRFCPNSERFSGYCRVNG ARYVRCCSRR | 1946 |
| AP00067 | P07493, Bombolitin II (insect, bee) | SKITDILAKLGKVLAHV | 1947 |
| AP00068 | P07494, Bombolitin III (insect, bee) | IKIMDILAKLGKVLAHV | 1948 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00069 | P07495, Bombolitin IV (insect, bee) | INIKDILAKLVKVLGHV | 1949 |
| AP00070 | P07496, Bombolitin V (insect, bee) | INVLGILGLLGKALSHL | 1950 |
| AP00236 | P07504, *Pyrularia* thionin (Pp-TH, plant) | KSCCRNTWARNCYNVCRLPGTISR EICAKKCDCKIISGTTCPSDYPK | 1951 |
| AP00230 | P08375, Sarcotoxin IA (insect, flesh | GWLKKIGKKIERVGQHTRDATIQG LGIAQQAANVAATAR | 1952 |
| AP00231 | P08376, Sarcotoxin IB (insect, flesh | GWLKKIGKKIERVGQHTRDATIQV IGVAQQAANVAATAR | 1953 |
| AP00232 | P08377, Sarcotoxin IC (insect, flesh | GWLRKIGKKIERVGQHTRDATIQV LGIAQQAANVAATAR | 1954 |
| AP00066 | P10521, Bombolitin I (insect, bee) | IKITTMLAKLGKVLAHV | 1955 |
| AP00206 | P10946, Lantibiotic subtilin (class I bacteriocin, bacteria) | WKSESLCTPGCVTGALQTCFLQTL TCNCKISK | 1956 |
| AP00312 | P11477, Cryptdin-2 (Crp2, animal defensin, alpha, mouse) | LRDLVCYCRARGCKGRERMNGTC RKGHLLYMLCCR | 1957 |
| AP00205 | P13068, Nisin A (lantibiotic, class I bacteriocin, bacteria) | ITSISLCTPGCKTGALMGCNMKTA TCHCSIHVSK | 1958 |
| AP00215 | P14214, Tachyplesin II (crabs, Crustacea) | RWCFRVCYRGICYRKCR | 1959 |
| AP00212 | P14216, Polyphemusin II (crabs, Crustacea, XXA, ZZHa. Derivatives: T22) | RRWCFRVCYKGFCYRKCR | 1960 |
| AP00134 | P14661, Cecropin P1 (pig) | SWLSKTAKKLENSAKKRISEGIAIA IQGGPR | 1961 |
| AP00011 | P14662, Bactericidin B2 (insect) | WNPFKELERAGQRVRDAVISAAPA VATVGQAAAIARG | 1962 |
| AP00032 | P14663, Bactericidin B-3 (insect) | WNPFKELERAGQRVRDAIISAGPA VATVGQAAAIARG | 1963 |
| AP00033 | P14664, Bactericidin B-4 (insect) | WNPFKELERAGQRVRDAIISAAPA VATVGQAAAIARG | 1964 |
| AP00034 | P14665, Bactericidin B-5P (insect) | WNPFKELERAGQRVRDAVISAAA VATVGQAAAIARG | 1965 |
| AP00125 | P14666, Cecropin (insect, silk moth) | RWKIFKKIEKVGQNIRDGIVKAGP AVAVVGQAATI | 1966 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00002 | P15450, ABAECIN (insect, honeybee) | YVPLPNVPQPGRRPFPTFPGQGPFN PKIKWPQGY | 1967 |
| AP00505 | P15516, human Histatin 5 (ZZHs; derivatives Dh-5) | DSHAKRHHGYKRKFHEKHHSHRGY | 1968 |
| AP00520 | P15516, human Histatin 3 | DSHAKRHHGYKRKFHEKHHSHRG YRSNYLYDN | 1969 |
| AP00523 | P15516, human Histatin 8 | KFHEKHHSHRGY | 1970 |
| AP00226 | P17722, Royalisin (insect, honeybee) | VTCDLLSFKGQVNDSACAANCLSL GKAGGHCEKVGCICRKTSFKDLW DKRF | 1971 |
| AP00213 | P18252, Tachyplesin III (horseshoe crabs, Crustacea) | KWCFRVCYRGICYRKCR | 1972 |
| AP00233 | P18312, Sarcotoxin ID (insect, flesh | GWIRDFGKRIERVGQHTRDATIQTI AVAQQAANVAATLKG | 1973 |
| AP00207 | P19578, Lantibiotic PEP5 (class I bacteriocin, bacteria) | TAGPAIRASVKQCQKTLKATRLFT VSCKGKNGCK | 1974 |
| AP00009 | P19660, BACTENECIN 5 (bac5, cow cathelicidin) | RFRPPIRRPPIRPPFYPPFRPPIRPPIF PPIRPPFRPPLGPFP | 1975 |
| AP00010 | P19661, BACTENECIN 7 (bac7, cow cathelicidin) | RRIRPRPPRLPRPRPRPLPFPRPGPR PIPRPLPFPRPGPRPIPRPLPFPRPGP RPIPRPL | 1976 |
| AP00200 | P21564, Mastoparan B (MP-B, insect, XXA) | LKLKSIVSWAKKVL | 1977 |
| AP00005 | P21663, Andropin (insect, fly) | VFIDILDKVENAIHNAAQVGIGFAK PFEKLINPK | 1978 |
| AP00008 | P22226, Cyclic dodecapeptide (cow cathelicidin) | RLCRIVVIRVCR | 1979 |
| AP01205 | P23826, Lactocin S (XXD3, bacteria) | STPVLASVAVSMELLPTASVLYSD VAGCFKYSAKHHC | 1980 |
| AP00239 | P24335, XPF (the xenopsin precursor fragment, African clawed frog) | GWASKIGQTLGKIAKVGLKELIQPK | 1981 |
| AP00235 | P25068, Bovine tracheal antimicrobial peptide (TAP, cow) | NPVSCVRNKGICVPIRCPGSMKQIG TCVGRAVKCCRKK | 1982 |
| AP00418 | P25230, CAP18 (rabbit cathelicidin, BBL) | GLRKRLRKFRNKIKEKLKKIGQKIQ GFVPKLAPRTDY | 1983 |

TABLE 14-continued

Other illustrative antimicrobial peptides. AP numbers refer to ID in antimicrobial peptide database (http://aps.unmc.edu/AP/main.php).

| Effector | | Structure/Sequence | SEQ ID No |
|---|---|---|---|
| AP00203 | P25403, Mj-AMP1 (MjAMP1, plant defensin) | QCIGNGGRCNENVGPPYCCSGFCL RQPGQGYGYCKNR | 1984 |
| AP00202 | P25404, Mj-AMP2 (MjAMP2, plant defensin) | CIGNGGRCNENVGPPYCCSGFCLR QPNQGYGVCRNR | 1985 |
| AP00138 | P28310, Cryptdin-3 (Crp3, animal defensin, alpha, mouse) | LRDLVCYCRKRGCKRRERMNGTC RKGHLMYTLCCR | 1986 |
| AP00184 | P28794, MBP-1 (plant) | RSGRGECRRQCLRRHEGQPWETQ ECMRRCRRRG | 1987 |
| AP00050 | P29002, Bombinin-like peptide 1 (BLP-1, toad) | GIGASILSAGKSALKGLAKGLAEHF AN | 1988 |
| AP00051 | P29003, Bombinin-like peptide 2 (BLP-2, toad) | GIGSAILSAGKSALKGLAKGLAEHF AN | 1989 |
| AP00052 | P29004, Bombinin-like peptide 3 (BLP-3, XXA, toad) | GIGAAILSAGKSALKGLAKGLAEHF | 1990 |
| AP00053 | P29005, Bombinin-like peptide 4 (BLP-4, toad) | GIGAAILSAGKSIIKGLANGLAEHF | 1991 |
| AP00634 | P29430, Pediocin PA-1/AcH (PedPA1, class IIA bacteriocin, bacteria) | KYYGNGVTCGKHSCSVDWGKATT CIINNGAMAWATGGHQGNHKC | 1992 |
| AP00204 | P29559, Nisin Z (lantibiotic, class I bacteriocin, bacteria) | ITSISLCTPGCKTGALMGCNMKTA TCNCSIHVSK | 1993 |
| AP00130 | P29561, Cecropin C (insect, fly) | GWLKKLGKRIERIGQHTRDATIQG LGIAQQAANVAATAR | 1994 |
| AP00001 | P31107, ADENOREGULIN (Dermaseptin B2, Dermaseptin-B2, DRS-B2, DRS B2, frog) | GLWSKIKEVGKEAAKAAAKAAGK AALGAVSEAV | 1995 |
| AP00228 | P31529, Sapecin B (insect, flesh fly) | LTCEIDRSLCLLHCRLKGYLRAYCS QQKVCRCVQ | 1996 |
| AP00229 | P31530, Sapecin C (insect, flesh fly) | ATCDLLSGIGVQHSACALHCVFRG NRGGYCTGKGICVCRN | 1997 |
| AP00218 | P32195, Protegrin 2 (PG-2, pig cathelicidin) | RGGRLCYCRRRFCICV | 1998 |
| AP00219 | P32196, Protegrin 3 (PG-3, pig cathelicidin) | RGGGLCYCRRRFCVCVGR | 1999 |
| AP00073 | P32412, Brevinin-1E (frog) | FLPLLAGLAANFLPKIFCKITRKC | 2000 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00080 | P32414, Esculentin-1 (frog) | GIFSKLGRKKIKNLLISGLKNVGKE VGMDVVRTGIDIAGCKIKGEC | 2001 |
| AP00074 | P32423, Brevinin-1 (frog) | FLPVLAGIAAKVVPALFCKITKKC | 2002 |
| AP00075 | P32424, Brevinin-2 (frog) | GLLDSLKGFAATAGKGVLQSLLST ASCKLAKTC | 2003 |
| AP00175 | P34084, Macaque histatin (M-Histatin 1, primate, monkey) | DSHEERHHGRHGHHKYGRKFHEK HHSHRGYRSNYLYDN | 2004 |
| AP00006 | P35581, Apidaecin IA (insect, honeybee) | GNNRPVYIPQPRPPHPRI | 2005 |
| AP00007 | P35581, Apidaecin IB (insect, honeybee) | GNNRPVYIPQPRPPHPRL | 2006 |
| AP00414 | P36190, Ceratotoxin A (insect, fly) | SIGSALKKALPVAKKIGKIALPIAK AALP | 2007 |
| AP00415 | P36191, Ceratotoxin B (insect, fly) | SIGSAFKKALPVAKKIGKAALPIAK AALP | 2008 |
| AP00172 | P36193, Drosocin (insect) | GKPRPYSPRPTSHPRPIRV | 2009 |
| AP00170 | P37362, Pyrrhocoricin (insect) | VDKGSYLPRPTPPRPIYNRN | 2010 |
| AP00635 | P38577, Mesentericin Y105 (MesY105, class IIA bacteriocin, bacteria) | KYYGNGVHCTKSGCSVNWGEAAS AGIHRLANGGNGFW | 2011 |
| AP00636 | P38579, Carnobacteriocin BM1 (CnbBM1, PiscV1b, class IIA bacteriocin, bacteria) | AISYGNGVYCNKEKCWVNKAENK QAITGIVIGGWASSLAGMGH | 2012 |
| AP00209 | P39080, Peptide PGQ (frog) | GVLSNVIGYLKKLGTGALNAVLKQ | 2013 |
| AP00513 | P39084, Ranalexin (frog) | FLGGLIKIVPAMICAVTKKC | 2014 |
| AP00071 | P40835, Brevinin-1EA (frog) | FLPAIFRMAAKVVPTIICSITKKC | 2015 |
| AP00072 | P40836, Brevinin-1EB (frog) | VIPFVASVAAEMQHVYCAASRKC | 2016 |
| AP00076 | P40837, Brevinin-2EA (frog) | GILDTLKNLAISAAKGAAQGLVNK ASCKLSGQC | 2017 |
| AP00077 | P40838, Brevinin-2EB (frog) | GILDTLKNLAKTAGKGALQGLVK MASCKLSGQC | 2018 |
| AP00078 | P40839, Brevinin-2EC (frog) | GILLDKLKNFAKTAGKGVLQSLLN TASCKLSGQC | 2019 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00079 | P40840, Brevinin-2ED (frog) | GILDSLKNLAKNAGQILLNKASCKLSGQC | 2020 |
| AP00081 | P40843, Esculentin-1A (frog) | GIFSKLAGKKIKNLLISGLKNVGKEVGMDVVRTGIDIAGCKIKGEC | 2021 |
| AP00082 | P40844, Esculentin-1B (frog) | GIFSKLAGKKLKNLLISGLKNVGKEVGMDVVRTGIDIAGCKIKGEC | 2022 |
| AP00083 | P40845, Esculentin-2A (frog) | GILSLVKGVAKLAGKGLAKEGGKFGLELIACKIAKQC | 2023 |
| AP00084 | P40846, Esculentin-2B (ES2B_RANES, frog) | GIFSLVKGAAKLAGKGLAKEGGKFGLELIACKIAKQC | 2024 |
| AP00299 | P46156, Chicken gallinacin 1 (Gal 1, avian beta-defensin, bird) | GRKSDCFRKSGFCAFLKCPSLTLISGKCSRFYLCCKRIW | 2025 |
| AP00300 | P46157, Gallinacin 1 alpha (avian beta-defensin, Bird), | GRKSDCFRKNGFCAFLKCPYLTLISGKCSRFHLCCKRIW | 2026 |
| AP00298 | P46158, Chicken gallinacin 2 (Gal 2, avian beta-defensin, bird) | LFCKGGSCHFGGCPSHLIKVGSCFGFRSCCKWPWNA | 2027 |
| AP00037 | P46160, Beta-defensin 2 (cow) | VRNHVTCRINRGFCVPIRCPGRTRQIGTCFGPRIKCCRSW | 2028 |
| AP00038 | P46161, Beta-defensin 3 (cow) | QGVRNHVTCRINRGFCVPIRCPGRTRQIGTCFGPRIKCCRSW | 2029 |
| AP00039 | P46162, Beta-defensin 4 (cow) | QRVRNPQSCRWNMGVCIPFLCRVGMRQIGTCFGPRVPCCRR | 2030 |
| AP00040 | P46163, Beta-defensin 5 (cow) | QVVRNPQSCRWNMGVCIPISCPGNMRQIGTCFGPRVPCCRRW | 2031 |
| AP00041 | P46164, Beta-defensin 6 (cow) | QGVRNHVTCRIYGGFCVPIRCPGRTRQIGTCFGRPVKCCRRW | 2032 |
| AP00042 | P46165, Beta-defensin 7 (cow) | QGVRNFVTCRINRGFCVPIRCPGHRRQIGTCLGPRIKCCR | 2033 |
| AP00043 | P46166, Beta-defensin 8 (cow) | VRNFVTCRINRGFCVPIRCPGHRRQIGTCLGPQIKCCR | 2034 |
| AP00044 | P46167, Beta-defensin 9 (cow) | QGVRNFVTCRINRGFCVPIRCPGHRRQIGTCLAPQIKCCR | 2035 |
| AP00045 | P46168, Beta-defensin 10 (cow) | QGVRSYLSCWGNRGICLLNRCPGRMRQIGTCLAPRVKCCR | 2036 |
| AP00046 | P46169, Beta-defensin 11 (cow) | GPLSCRRNGGVCIPIRCPGPMRQIGTCFGRPVKCCRSW | 2037 |
| AP00048 | P46171, Bovine beta-defensin 13 (cow) | SGISGPLSCGRNGGVCIPIRCPVPMRQIGTCFGRPVKCCRSW | 2038 |
| AP00350 | P48821, Enbocin (insect, moth) | PWNIFKEIERAVARTRDAVISAGPAVRTVAAATSVAS | 2039 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00173 | P49112, GNCP-2 (Guinea pig neutrophil cationic peptide 2) | RCICTTRTCRFPYRRLGTCLFQNRV YTFCC | 2040 |
| AP00369 | P49930, PMAP-23 (PMAP23, pig cathelicidin) | RIIDLLWRVRRPQKPKFVTVWVR | 2041 |
| AP00370 | P49931, PMAP-36 (PMAP36, pig cathelicidin) | VGRFRRLRKKTRKRLKKIGKVLK WIPPIVGSIPLGCG | 2042 |
| AP00371 | P49932, PMAP-37 (PMAP37, pig cathelicidin) | GLLSRLRDFLSDRGRRLGEKIERIG QKIKDLSEFFQS | 2043 |
| AP00220 | P49933, Protegrin 4 (PG-4, pig cathelicidin) | RGGRLCYCRGWICFCVGR | 2044 |
| AP00221 | P49934, Protegrin 5 (PG-5, pig cathelicidin) | RGGRLCYCRPRFCVCVGR | 2045 |
| AP00346 | P50720, Hyphancin IIID (Fall webworm, insect) | RWKIFKKIERVGQNVRDGIIKAGP AIQVLGTAKAL | 2046 |
| AP00347 | P50721, Hyphancin IIIE (Fall webworm, insect) | RWKFFKKIERVGQNVRDGLIKAGP AIQVLGAAKAL | 2047 |
| AP00348 | P50722, Hyphancin IIIF (Fall webworm, insect) | RWKVFKKIEKVGRNIRDGVIKAGP AIAVVGQAKAL | 2048 |
| AP00349 | P50723, Hyphancin IIIG (Fall webworm, insect) | RWKVFKKIEKVGRHIRDGVIKAGP AITVVGQATAL | 2049 |
| AP00281 | P51473, mCRAMP (mouse cathelicidin; derivatives: CRAMP 18) | GLLRKGGEKIGEKLKKIGQKIKNFF QKLVPQPEQ | 2050 |
| AP00366 | P54228, BMAP-27 (BMAP27, cow cathelicidin, ZZHs, derivatives BMAP-18 and BMAP-15) | GRFKRFRKKFKKLFKKLSPVIPLLH LG | 2051 |
| AP00367 | P54229, BMAP-28 (BMAP28, cow cathelicidin) | GGLRSLGRKILRAWKKYGPIIVPIIR IG | 2052 |
| AP00450 | P54230, Cyclic dodecapeptide (sheep cathelicidin) | RICRIIFLRVCR | 2053 |
| AP00359 | P54684, Lebocin 1/2 (insect, silk moth) | DLRFLYPRGKLPVPTPPPFNPKPIYI DMGNRY | 2054 |
| AP00360 | P55796, Lebocin 3 (insect, silk moth) | DLRFLYPRGKLPVPTLPPFNPKPIYI DMGNRY | 2055 |
| AP00307 | P55897, Buforin I (toad) | AGRGKQGGKVRAKAKTRSSRAGL QFPVGRVHRLLRKGNY | 2056 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00308 | P55897, Buforin II (toad) | TRSSRAGLQFPVGRVHRLLRK | 2057 |
| AP00240 | P56226, Caerin 1.1 (frog, ZZHa) | GLLSVLGSVAKHVLPHVVPVIAEHL | 2058 |
| AP00241 | P56227, Caerin 1.2 (frog) | GLLGVLGSVAKHVLPHVVPVIAEHL | 2059 |
| AP00242 | P56228, Caerin 1.3 (frog) | GLLSVLGSVAQHVLPHVVPVIAEHL | 2060 |
| AP00243 | P56229, Caerin 1.4 (frog) | GLLSSLSSVAKHVLPHVVPVIAEHL | 2061 |
| AP00244 | P56230, Caerin 1.5 (frog) | GLLSVLGSVVKHVIPHVVPVIAEHL | 2062 |
| AP00245 | P56231, Caerin 1.6 (frog) | GLFSVLGAVAKHVLPHVVPVIAEK | 2063 |
| AP00246 | P56232, Caerin 1.7 (frog) | GLFKVLGSVAKHLLPHVAPVIAEK | 2064 |
| AP00249 | P56233, Caerin 2.1 (frog) | GLVSSIGRALGGLLADVVKSKGQPA | 2065 |
| AP00250 | P56234, Caerin 2.2 (frog) | GLVSSIGRALGGLLADVVKSKEQPA | 2066 |
| AP00251 | P56236, Caerin 2.4 (frog) | GLVSSIGKALGGLLADVVKTKEQPA | 2067 |
| AP00252 | P56236, Caerin 2.5 (frog) | GLVSSIGRALGGLLADVVKSKEQPA | 2068 |
| AP00253 | P56238, Caerin 3.1 (frog) | GLWQKIKDKASELVSGIVEGVK | 2069 |
| AP00254 | P56238, Caerin 3.2 (frog) | GLWEKIKEKASELVSGIVEGVK | 2070 |
| AP00255 | P56240, Caerin 3.3 (frog) | GLWEKIKEKANELVSGIVEGVK | 2071 |
| AP00256 | P56241, Caerin 3.4 (frog) | GLWEKIREKANELVSGIVEGVK | 2072 |
| AP00257 | P56242, Caerin 4.1 (frog) | GLWQKIKSAAGDLASGIVEGIKS | 2073 |
| AP00258 | P56243, Caerin 4.2 (frog) | GLWQKIKSAAGDLASGIVEGIKS | 2074 |
| AP00259 | P56244, Caerin 4.3 (frog) | GLWQKIKNAAGDLASGIVEGIKS | 2075 |
| AP00434 | P56249, Frenatin 3 (frog) | GLMSVLGHAVGNVLGGLFKS | 2076 |
| AP00272 | P56386, Murine beta-defensin 1 (mBD-1, mouse) | DQYKCLQHGGFCLRSSCPSNTKLQ GTCKPDKPNCCKS | 2077 |
| AP00368 | P56425, BMAP-34 (BMAP34, cow cathelicidin) | GLFRRLRDSIRRGQQKILEKARRIG ERIKDIFRG | 2078 |
| AP00273 | P56685, Buthinin (Sahara scorpion) | SIVPIRCRSNRDCRRFCGFRGGRCT YARQCLCGY | 2079 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00282 | P56872, Cyclopsychotride A (CPT, plant cyclotides, XXC) | SIPCGESCVFIPCTVTALLGCSCKSK VCYKN | 2080 |
| AP00094 | P56917, Temporin A (XXA, frog) | FLPLIGRVLSGIL | 2081 |
| AP00096 | P56918, Temporin C (XXA, frog) | LLPILGNLLNGLL | 2082 |
| AP00097 | P56920, Temporin E (XXA, frog) | VLPIIGNLLNSLL | 2083 |
| AP00098 | P56921, Temporin F (XXA, frog) | FLPLIGKVLSGIL | 2084 |
| AP00100 | P56923, Temporin K (XXA, frog) | LLPNLLKSLL | 2085 |
| AP00295 | P56928, eNAP-2 (horse) | EVERKHPLGGSRPGRCPTVPPGTF GHCACLCTGDASEPKGQKCCSN | 2086 |
| AP00101 | P57104, Temporin L (XXA, frog) | FVQWFSKFLGRIL | 2087 |
| AP00095 | P79874, Temporin B (XXA, frog) | LLPIVGNLLKSLL | 2088 |
| AP00099 | P79875, Temporin G (XXA, frog) | FFPVIGRILNGIL | 2089 |
| AP00413 | P80032, Coleoptericin (insect) | SLQGGAPNFPQPSQQNGGWQVSP DLGRDDKGNTRGQIEIQNKGKDH DFNAGWGKVIRGPNKAKPTWHVG GTYRR | 2090 |
| AP00396 | P80054, PR-39 (PR39, pig cathelicidin) | RRRPRPPYLPRPRPPPFFPPRLPPRIP PGFPPRFPPRFP | 2091 |
| AP00182 | P80154, Insect defensin | GFGCPLDQMQCHRHCQTITGRSGG YCSGPLKLTCTCYR | 2092 |
| AP00444 | P80223, Corticostatin VI (CS-VI) (animal defensin, rabbit) | GICACRRRFCLNFEQFSGYCRVNG ARYVRCCSRR | 2093 |
| AP00208 | P80230, Peptide 3910 (pig) | RADTQTYQPYNKDWIKEKIYVLLR RQAQQAGK | 2094 |
| AP00157 | P80277, Dermaseptin-S1 (Dermaseptin S1, DRS S1, DRS-S1, frog) | ALWKTMLKKLGTMALHAGKAAL GAAADTISQGTQ | 2095 |
| AP00158 | P80278, Dermaseptin-S2 (Dermaseptin S2, DRS S2, DRS-S2, frog) | ALWFTMLKKLGTMALHAGKAAL GAAANTISQGTQ | 2096 |
| AP00159 | P80279, Dermaseptin-S3 (Dermaseptin S3, DRS S3, DRS-S3, frog) | ALWKNMLKGIGKLAGKAALGAV KKLVGAES | 2097 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00160 | P80280, Dermaseptin-S4 (Dermaseptin S4, DRS S4, DRS-S4, frog) | ALWMTLLKKVLKAAAKALNAVL VGANA | 2098 |
| AP00161 | P80281, Dermaseptin-S5 (Dermaseptin S5, DRS S5, DRS-S5, frog) | GLWSKIKTAGKSVAKAAAKAAVK AVTNAV | 2099 |
| AP00293 | P80282, Dermaseptin-B1 (DRS-B1, DRS B1, frog) | AMWKDVLKKIGTVALHAGKAAL GAVADTISQ | 2100 |
| AP00264 | P80389, Chicken Heterophil Peptide 1 (CHP1, bird, animal) | GRKSDCFRKSGFCAFLKCPSLTLIS GKCSRFYLCCKRIR | 2101 |
| AP00265 | P80390, Chicken Heterophil Peptide 2 (CHP2, bird, animal) | GRKSDCFRKNGFCAFLKCPYLTLIS GLCSFHLC | 2102 |
| AP00266 | P80391, Turkey Heterophil Peptide 1 (THP1, turkey) | GKREKCLRRNGFCAFLKCPTLSVIS GTCSRFQVCC | 2103 |
| AP00267 | P80392, Turkey Heterophil Peptide 2 (THP2, bird, anaimal) | LFCKRGTCHFGRCPSHLIKVGSCFG FRSCCKWPWDA | 2104 |
| AP00269 | P80393, Turkey Heterophil Peptide 3 (THP3, bird, animal) | LSCKRGTCHFGRCPSHLIKGSCSGG | 2105 |
| AP00085 | P80395, Gaegurin-1 (Gaegurin 1, frog) | SLFSLIKAGAKFLGKNLLKQGACY AACKASKQC | 2106 |
| AP00086 | P80396, Gaegurin-2 (Gaegurin 2, frog) | GIMSIVKDVAKNAAKEAAKGALST LSCKLAKTC | 2107 |
| AP00087 | P80397, Gaegurin-3 (Gaegurin 3, frog) | GIMSIVKDVAKTAAKEAAKGALST LSCKLAKTC | 2108 |
| AP00089 | P80399, Gaegurin-5 (Gaegurin 5, frog) | FLGALFKVASKVLPSVFCAITKKC | 2109 |
| AP00090 | P80400, Gaegurin-6 (Gaegurin 6, frog) | FLPLLAGLAANFLPTIICKISYKC | 2110 |
| AP00362 | P80408, Metalnikowin I (insect) | VDKPDYRPRPRPPNM | 2111 |
| AP00363 | P80409, Metalnikowin IIA (insect) | VDKPDYRPRPWPRPN | 2112 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00364 | P80410, Metalnikowin IIB (insect) | VDKPDYRPRPWPRNMI | 2113 |
| AP00365 | P80411, Metalnikowin III (insect) | VDKPDYRPRPWPRPNM | 2114 |
| AP00632 | P80569, Piscicolin 126/Piscicocin Vla (PiscV1a, Pisc126, class IIA bacteriocin, bacteria) | KYYGNGVSCNKNGCTVDWSKAIG IIGNNAAANLTTGGAAGWNKG | 2115 |
| AP01003 | P80666, Mutacin B-Ny266 (bacteria) | FKSWSFCTPGCAKTGSFNSYCC | 2116 |
| AP00276 | P80710, Clavanin A (urochordates, sea squirts, and sea pork, tunicate) | VFQFLGKIIHHVGNFVHGFSHVF | 2117 |
| AP00277 | P80711, Clavanin B (Sea squirt, tunicate) | VFQFLGRIIHHVGNFVHGFSHVF | 2118 |
| AP00278 | P80712, Clavanin C (Sea squirt, tunicate) | VFHLLGKIIHHVGNFVYGFSHVF | 2119 |
| AP00279 | P80713, Clavanin D (Sea squirt, tunicate) | AFKLLGRIIHHVGNFVYGFSHVF | 2120 |
| AP00280 | P80713, Clavanin D (Sea squirt, tunicate) | LFKLLGKIIHHVGNFVHGFSHVF | 2121 |
| AP00294 | P80930, eNAP-1 (horse) | DVQCGEGHFCHDQTCCRASQGGA CCPYSQGVCCADQRHCCPVGF | 2122 |
| AP00400 | P80952, Skin peptide tyrosine-tyrosine (skin-PYY, SPYY, frog) | YPPKPESPGEDASPEEMNKYLTAL RHYINLVTRQRY | 2123 |
| AP00091 | P80954, Rugosin A (frog) | GLLNTFKDWAISIAKGAGKGVLTT LSCKLDKSC | 2124 |
| AP00092 | P80955, Rugosin B (frog) | SLFSLIKAGAKFLGKNLLKQGAQY AACKVSKEC | 2125 |
| AP00093 | P80956, Rugosin C (frog) | GILDSFKQFAKGVGKDLIKGAAQG VLSTMSCKLAKTC | 2126 |
| AP00392 | P81056, Penaeidin-1 (shrimp, Crustacea) | YRGGYTGPIPRPPPIGRPPLRLVVC ACYRLSVSDARNCCIKFGSCCHLVK | 2127 |
| AP00393 | P81057, Penaeidin-2a (shrimp, Crustacea) | YRGGYTGPIPRPPPIGRPPFRPVCN ACYRLSVSDARNCCIKFGSCCHLVK | 2128 |
| AP00394 | P81058, Penaeidin-3a (shrimp, Crustacea) | QVYKGGYTRPIPRPPPFVRPLPGGP IGPYNGCPVSCRGISFSQARSCCSR LGRCCHVGKGYS | 2129 |
| AP00247 | P81251, Caerin 1.8 (frog) | GLFKVLGSVAKHLLPHVVPVIAEK | 2130 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00248 | P81252, Caerin 1.9 (frog, ZZHa) | GLFGVLGSIAKHVLPHVVPVIAEK | 2131 |
| AP00126 | P81417, Cecropin A (insect, mosquito) | GGLKKLGKKLEGVGKRVFKASEK ALPVAVGIKALG | 2132 |
| AP00169 | P81437, Formaecin 2 (insect, ants) | GRPNPVNTKPTPYPRL | 2133 |
| AP00168 | P81438, Formaecin 1 (insect, ants) | GRPNPVNNKPTPHPRL | 2134 |
| AP00296 | P81456, Fabatin-1 (plant defensin) | LLGRCKVKSNRFHGPCLTDTHCST VCRGEGYKGGDCHGLRRRCMCLC | 2135 |
| AP00297 | P81457, Fabatin-2 (plant defensin) | LLGRCKVKSNRFNGPCLTDTHCST VCRGEGYKGGDCHGLRRRCMCLC | 2136 |
| AP01215 | P81463, European bumblebee abaecin (insect) | FVPYNPPRPYQSKPFPSFPGHGPFN PKIQWPYPLPNPGH | 2137 |
| AP01214 | P81464, Apidaecin (insect) | GNRPVYIPPPRPPHPRL | 2138 |
| AP00440 | P81465, defensin HANP-1 (hamster) | VTCFCRRRGCASRERHIGYCRFGN TIYRLCCRR | 2139 |
| AP00441 | P81466, defensin HANP-2 (hamster) | CFCKRPVCDSGETQIGYCRLGNTF YRLCCRQ | 2140 |
| AP00442 | P81467, defensin HANP-3 (hamster) | VTCFCRRRGCASRERLIGYCRFGN TIYGLCCRR | 2141 |
| AP00439 | P81468, defensin HANP-4 (hamster) | VTCFCKRPVCDSGETQIGYCRLGN TFYRLCCRQ | 2142 |
| AP00328 | P81469, Styelin A (Sea squirt, tunicate, XXA) | GFGKAFHSVSNFAKKHKTA | 2143 |
| AP00329 | P81470, Styelin B (Sea squirt, tunicate, XXA) | GFGPAFHSVSNFAKKHKTA | 2144 |
| AP00492 | P81474, Misgurin (fish) | RQRVEELSKFSKKGAAARRRK | 2145 |
| AP00165 | P81485, Dermaseptin-B3 (Dermaseptin B3, DRS-B3, DRS B3, frog) | ALWKNMLKGIGKLAGQAALGAV KTLVGAE | 2146 |
| AP00163 | P81486, Dermaseptin-B4 (Dermaseptin B4, DRS-B4, DRS B4, DRS-TR1, IRP, frog) | ALWKDILKNVGKAAGKAVLNTVT DMVNQ | 2147 |
| AP00162 | P81487, Dermaseptin-B5 (Dermaseptin B5, DRS-B5, DRS B5, frog) | GLWNKIKEAASKAAGKAALGFVN EMV | 2148 |
| AP00164 | P81488, Dermaseptin-B9 | ALWKTIIKGAGKMIGSLAKNLLGS QAQPES | 2149 |

TABLE 14-continued

Other illustrative antimicrobial peptides. AP numbers refer to ID in antimicrobial peptide database (http://aps.unmc.edu/AP/main.php).

| Effector | | Structure/Sequence | SEQ ID No |
|---|---|---|---|
| | (Dermaseptin B9, DRS-B9, DRS DRG3, frog) | | |
| AP00167 | P81565, Phylloxin (phylloxin-B1, PLX-B1, XXA, frog) | GWMSKIASGIGTFLSGMQQ | 2150 |
| AP00291 | P81568, Defensin D5 (So-D5) (plant defensin) | MFFSSKKCKTVSKTFRGPCVRNAN | 2151 |
| AP00290 | P81569, Defensin D4 (So-D4) (plant defensin) | MFFSSKKCKTVSKTFRGPCVRNA | 2152 |
| AP00289 | P81570, Defensin D3 (So-D3) (plant defensin) | GIFSSRKCKTVSKTFRGICTRNANC | 2153 |
| AP00288 | P81572, Defensin D1 (So-D1) (plant defensin) | TCESPSHKFKGPCATNRNCES | 2154 |
| AP00292 | P81573, Defensin D7 (So-D7) (plant defensin) | GIFSSRKCKTPSKTFKGYCTRDSNC DTSCRYEGYPAGD | 2155 |
| AP00270 | P81591, Pn-AMP (PnAMP, plant defensin) | QQCGRQASGRLCGNRLCCSQWGY CGSTASYCGAGCQSQCRS | 2156 |
| AP00412 | P81592, Acaloleptin A1 (insect) | SLQPGAPNVNNKDQPWQVSPHISR DDSGNTRTDINVQRHGENNDFEAG WSKVVRGPNKAKPTWHIGGTHRW | 2157 |
| AP00433 | P81605, human Dermcidin (DCD-1) | SSLLEKGLDGAKKAVGGLGKLGK DAVEDLESVGKGAVHDVKDVLDSV | 2158 |
| AP00332 | P81612, Mytilin A (Blue mussel) | GCASRCKAKCAGRRCKGWASASF RGRCYCKCFRC | 2159 |
| AP00333 | P81613, Mytilin B (Blue mussel) | SCASRCKGHCRARRCGYYVSVLY RGRCYCKCLRC | 2160 |
| AP00334 | P81613, Moronecidin (fish) | FFHHIFRGIVHVGKTIHKLVTG | 2161 |
| AP00351 | P81835, Citropin 1.1 (amphibian, frog) | GLFDVIKKVASVIGGL | 2162 |
| AP00352 | P81840, Citropin 1.2 (amphibian, frog) | GLFDIIKKVASVVGGL | 2163 |
| AP00353 | P81846, Citropin 1.3 (amphibian, frog) | GLFDIIKKVASVIGGL | 2164 |
| AP00338 | P81903, Histone H2B-1(HLP-1) (fish) | PDPAKTAPKKGSKKAVTKA | 2165 |
| AP00271 | P82018, ChBac5 (Goat cathelicidin) | RFRPPIRRPPIRPPFNPPFRPPVRPPF RPPFRPPFRPPIGPFP | 2166 |
| AP00316 | P82027, Uperin 2.1 (amphibian, toad) | GIVDFAKKVVGGIRNALGI | 2167 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00317 | P82028, Uperin 2.2 (amphibian, toad) | GFVDLAKKVVGGIRNALGI | 2168 |
| AP00318 | P82029, Uperin 2.3 (amphibian, toad) | GFFDLAKKVVGGIRNALGI | 2169 |
| AP00319 | P82030, Uperin 2.4 (amphibian, toad) | GILDFAKTVVGGIRNALGI | 2170 |
| AP00320 | P82031, Uperin 2.5 (amphibian, toad) | GIVDFAKGVLGKIKNVLGI | 2171 |
| AP00323 | P82032, Uperin 3.1 (amphibian, toad) | GVLDAFRKIATVVKNVV | 2172 |
| AP00326 | P82035, Uperin 4.1 (amphibian, toad) | GVGSFIHKVVSAIKNVA | 2173 |
| AP00321 | P82039, Uperin 2.7 (amphibian, toad) | GIIDIAKKLVGGIRNVLGI | 2174 |
| AP00322 | P82040, Uperin 2.8 (amphibian, toad) | GILDVAKTLVGKLRNVLGI | 2175 |
| AP00324 | P82042, Uperin 3.5 (amphibian, toad) | GVGDLIRKAVSVIKNIV | 2176 |
| AP00325 | P82042, Uperin 3.6 (amphibian, toad) | GVIDAAKKVVNVLKNLP | 2177 |
| AP00327 | P82050, Uperin 7.1 (amphibian, frog) | GWFDVVKHIASAV | 2178 |
| AP00260 | P82066, Maculatin 1.1 (XXA, frog, ZZHa) | GLFGVLAKVAAHVVPAIAEHF | 2179 |
| AP00261 | P82067, Maculatin 1.2 (XXA, frog) | GLFVGLAKVAAHNNPAIAEHFQA | 2180 |
| AP00262 | P82068, Maculatin 2.1 (frog) | GFVDFLKKVAGTIANVVT | 2181 |
| AP00263 | P82069, Maculatin 3.1 (frog) | GLLQTIKEKLESLESLAKGIVSGIQA | 2182 |
| AP00345 | P82104, Caerin 1.10 (frog) | GLLSVLGSVAKHVLPHVVPVIAEKL | 2183 |
| AP00456 | P82232, Brevinin-1T (frog) | VNPIILGVLPKFVCLITKKC | 2184 |
| AP00459 | P82233, Brevinin-1TA (frog) | FITLLLRKFICSITKKC | 2185 |
| AP00457 | P82234, Brevinin-2TC (frog) | GLWETIKNFGKKFTLNILHKLKCKIGGGC | 2186 |
| AP00458 | P82235, Brevinin-2TD (frog) | GLWETIKNFGKKFTLNILHNLKCKIGGGC | 2187 |
| AP00397 | P82238, Salmocidin 2A (fish, trout) | SGFVLKGYTKTSQ | 2188 |
| AP00398 | P82239, Salmocidin 2B (fish, trout) | AGFVLKGYTKTSQ | 2189 |
| AP00055 | P82282, Bombinin H1 (frog) | IIGPVLGMVGSALGGLLKKI | 2190 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00056 | P82284, Bombinin H4 (frog, XXA, XXD) | LIGPVLGLVGSALGGLLKKI | 2191 |
| AP00057 | P82285, Bombinin H5 (frog, XXD) | IIGPVLGLVGSALGGLLKKI | 2192 |
| AP00419 | P82286, Bombinin-like peptides 2 (amphibian, toad) | GIGASILSAGKSALKGFAKGLAEHFAN | 2193 |
| AP00137 | P82293, Cryptdin-1 (Crp1, animal defensin, alpha, mouse) | LRDLVCYCRTRGCKRRERMNGTCRKGHLMYTLCCR | 2194 |
| AP00443 | P82317, defensin RMAD-2 (monkey) | ACYCRIPACLAGERRYGTCFYMGRVWAFCC | 2195 |
| AP00012 | P82386, Aurein 1.1 (amphibian, frog) | GLFDIIKKIAESI | 2196 |
| AP00014 | P82388, Aurein 2.1 (amphibian, frog) | GLLDIVKKVVGAFGSL | 2197 |
| AP00015 | P82389, Aurein 2.2 (amphibian, frog) | GLFDIVKKVVGALGSL | 2198 |
| AP00016 | P82390, Aurein 2.3 (XXA, amphibian, frog) | GLFDIVKKVVGAIGSL | 2199 |
| AP00017 | P82391, Aurein 2.4 (XXA, amphibian, frog) | GLFDIVKKVVGTIAGL | 2200 |
| AP00018 | P82392, Aurein 2.5 (XXA, amphibian, frog) | GLFDIVKKVVGAFGSL | 2201 |
| AP00019 | P82393, Aurein 2.6 (XXA, amphibian, frog) | GLFDIAKKVIGVIGSL | 2202 |
| AP00020 | P82394, Aurein 3.1 (XXA, amphibian, frog) | GLFDIVKKIAGHIAGSI | 2203 |
| AP00021 | P82395, Aurein 3.2 (XXA, amphibian, frog) | GLFDIVKKIAGHIASSI | 2204 |
| AP00022 | P82396, Aurein 3.3 (XXA, amphibian, frog) | GLFDIVKKIAGHIVSSI | 2205 |
| AP00376 | P82414, Ponericin G1 (ants) | GWKDWAKKAGGWLKKKGPGMAKAALKAAMQ | 2206 |
| AP00377 | P82415, Ponericin G2 (ants) | GWKDWLKKGKEWLKAKGPGIVKAALQAATQ | 2207 |
| AP00378 | P82416, Ponericin G3 (ants) | GWKDWLNKGKEWLKKKGPGIMKAALKAATQ | 2208 |
| AP00379 | P82417, Ponericin G4 (ants) | DFKDWMKTAGEWLKKKGPGILKAAMAAAT | 2209 |
| AP00380 | P82418, Ponericin G5 (ants) | GLKDWVKIAGGWLKKKGPGILKAAMAAATQ | 2210 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00381 | P82419, Ponericin G6 (ants) | GLVDVLGKVGGLIKKLLP | 2211 |
| AP00382 | P82420, Ponericin G7 (ants) | GLVDVLGKVGGLIKKLLPG | 2212 |
| AP00383 | P82421, Ponericin L1 (ants) | LLKELWTKMKGAGKAVLGKIKGLL | 2213 |
| AP00384 | P82422, Ponericin L2 (ants) | LLKELWTKIKGAGKAVLGKIKGLL | 2214 |
| AP00386 | P82423, Ponericin W1 (ants) | WLGSALKIGAKLLPSVVGLFKKKQ | 2215 |
| AP00387 | P82424, Ponericin W2 (ants) | WLGSALKIGAKLLPSVVGLFQKKK | 2216 |
| AP00388 | P82425, Ponericin W3 (ants) | GIWGTLAKIGIKAVPRVISMLKKKKQ | 2217 |
| AP00389 | P82426, Ponericin W4 (ants) | GIWGTALKWGVKLLPKLVGMAQTKKQ | 2218 |
| AP00390 | P82427, Ponericin W5 (ants) | FWGALIKGAAKLIPSVVGLFKKKQ | 2219 |
| AP00391 | P82428, Ponericin W6 (ants) | FIGTALGIASAIPAIVKLFK | 2220 |
| AP00303 | P82651, Tigerinin-1 (frog) | FCTMIPIPRCY | 2221 |
| AP00304 | P82652, Tigerinin-2 (frog) | RVCFAIPLPICH | 2222 |
| AP00305 | P82653, Tigerinin-3 (frog) | RVCYAIPLPICY | 2223 |
| AP00301 | P82656, Hadrurin (scorpion) | GILDTIKSIASKVWNSKTVQDLKRKGINWVANKLGVSPQAA | 2224 |
| AP00113 | P82740, RANATUERIN 1T (frog) | GLLSGLKKVGKHVAKNVAVSLMDSLKCKISGDC | 2225 |
| AP00114 | P82741, RANATUERIN 1 (Ranatuerin-1, frog) | SMLSVLKNLGKVGLGFVACKINKQC | 2226 |
| AP00115 | P82742, RANATUERIN 2 (Ranatuerin-2, frog) | GLFLDTLKGAAKDVAGKLEGLKCKITGCKLP | 2227 |
| AP00116 | P82780, RANATUERIN 3 (Ranatuerin-3, frog) | GFLDIINKLGKTFAGHMLDKIKCTIGTCPPSP | 2228 |
| AP00117 | P82819, RANATUERIN 4 (Ranatuerin-4, frog) | FLPFIARLAAKVFPSIICSVTKKC | 2229 |
| AP00405 | P82821, RANATUERIN 6 (frog) | FISAIASMLGKFL | 2230 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00406 | P82822, RANATUERIN 7 (frog) | FLSAIASMLGKFL | 2231 |
| AP00407 | P82823, RANATUERIN 8 (frog) | FISAIASFLGKFL | 2232 |
| AP00408 | P82824, RANATUERIN 9 (frog) | FLFPLITSFLSKVL | 2233 |
| AP00461 | P82825, Brevinin-1LA (frog) | FLPMLAGLAASMVPKLVCLITKKC | 2234 |
| AP00462 | P82826, Brevinin-1LB (frog) | FLPMLAGLAASMVPKFVCLITKKC | 2235 |
| AP00118 | P82828, RANATUERIN 2La (Ranatuerin-2La, frog) | GILDSFKGVAKGVAKDLAGKLLDKLKCKITGC | 2236 |
| AP00119 | P82829, RANATUERIN 2Lb (Ranatuerin-2Lb, frog) | GILSSIKGVAKGVAKNVAAQLLDTLKCKITGC | 2237 |
| AP00109 | P82830, Temporin-1La (Temporin 1La, frog) | VLPLISMALGKLL | 2238 |
| AP00110 | P82831, Temporin-1Lb (Temporin 1Lb, frog) | NFLGTLINLAKKIM | 2239 |
| AP00111 | P82832, Temporin-1Lc (Temporin 1Lc, frog) | FLPILINLIHKGLL | 2240 |
| AP00463 | P82833, Brevinin-1BA (frog) | FLPFIAGMAAKFLPKIFCAISKKC | 2241 |
| AP00464 | P82834, Brevinin-1BB (frog) | FLPAIAGMAAKFLPKIFCAISKKC | 2242 |
| AP00465 | P82835, Brevinin-1BC (frog) | FLPFIAGVAAKFLPKIFCAISKKC | 2243 |
| AP00466 | P82836, Brevinin-1BD (frog) | FLPAIAGVAAKFLPKIFCAISKKC | 2244 |
| AP00467 | P82837, Brevinin-1BE (frog) | FLPAIVGAAAKFLPKIFCVISKKC | 2245 |
| AP00468 | P82838, Brevinin-1BF (frog) | FLPFIAGMAANFLPKIFCAISKKC | 2246 |
| AP00120 | P82840, RANATUERIN 2B (Ranatuerin-2B, frog) | GLLDTIKGVAKTVAASMLDKLKCKISGC | 2247 |
| AP00469 | P82841, Brevinin-1PA (frog) | FLPIIAGVAAKVFPKIFCAISKKC | 2248 |
| AP00460 | P82842, Brevinin-1PB (frog) | FLPIIAGIAAKVFPKIFCAISKKC | 2249 |
| AP00470 | P82843, Brevinin-1PC (frog) | FLPIIASVAAKVFSKIFCAISKKC | 2250 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00471 | P82844, Brevinin-1PD (frog) | FLPIIASVAANVFSKIFCAISKKC | 2251 |
| AP00472 | P82845, Brevinin-1PE (frog) | FLPIIASVAAKVFPKIFCAISKKC | 2252 |
| AP00121 | P82847, RANATUERIN 2P (Ranatuerin-2P, frog) | GLMDTVKNVAKNLAGHMLDKLK CKITGC | 2253 |
| AP00112 | P82848, Temporin-1P (Temporin 1P, frog) | FLPIVGKLLSGLL | 2254 |
| AP00452 | P82871, Brevinin-1SY (frog) | FLPVVAGLAAKVLPSIICAVTKKC | 2255 |
| AP00122 | P82875, Ranatuerin-1C (Ranatuerin 1C, frog) | SMLSVLKNLGKVGLGLVACKINK QC | 2256 |
| AP00514 | P82876, Ranalexin-1Ca (frog) | FLGGLMKAFPALICAVTKKC | 2257 |
| AP00515 | P82877, Ranalexin-1Cb (frog) | FLGGLMKAFPAIICAVTKKC | 2258 |
| AP00124 | P82878, Ranatuerin-2Ca (Ranatuerin 2Ca, frog) | GLFLDTLKGAAKDVAGKLLEGLK CKIAGCKP | 2259 |
| AP00123 | P82879, Ranatuerin-2Cb (Ranatuerin 2Cb, frog) | GLFLDTLKGLAGKLLQGLKCIKAG CKP | 2260 |
| AP00104 | P82880, Temporin-1Ca (Temporin 1Ca, frog) | FLPFLAKILTGVL | 2261 |
| AP00105 | P82881, Temporin-1Cb (Temporin 1Cb, frog) | FLPLFASLIGKLL | 2262 |
| AP00106 | P82882, Temporin-1Cc (Temporin 1Cc, frog) | FLPFLASLLTKVL | 2263 |
| AP00107 | P82883, Temporin-1Cd (Temporin 1Cd, frog) | FLPFLASLLSKVL | 2264 |
| AP00108 | P82884, Temporin-1Ce (Temporin 1Ce, frog) | FLPFLATLLSKVL | 2265 |
| AP00453 | P82904, Brevinin-1SA (frog) | FLPAIVGAAGQFLPKIFCAISKKC | 2266 |
| AP00454 | P82905, Brevinin-1SB (frog) | FLPAIVGAAGKFLPKIFCAISKKC | 2267 |
| AP00455 | P82906, Brevinin-1SC (frog) | FFPIVAGVAGQVLKKIYCTISKKC | 2268 |
| AP00996 | P82907, Lichenin (bacteria) | ISLEICAIFHDN | 2269 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00302 | P82951, Hepcidin (fish) | GCRFCCNCCPNMSGCGVCCRF | 2270 |
| AP00058 | P83080, Maximin 1 (toad) | GIGTKILGGVKTALKGALKELASTYAN | 2271 |
| AP00059 | P83081, Maximin 2 (toad) | GIGTKILGGVKTALKGALKELASTYVN | 2272 |
| AP00060 | P83082, Maximin 3 (toad, ZZHa) | GIGGKILSGLKTALKGAAKELASTYLH | 2273 |
| AP00061 | P83083, Maximin 4 (toad) | GIGGVLLSAGKAALKGLAKVLAEKYAN | 2274 |
| AP00062 | P83084, Maximin 5 (toad) | SIGAKILGGVKTFFKGALKELASTYLQ | 2275 |
| AP00063 | P83085, Maximin 6 (toad) | ILGPVISTIGGVLGGLLKNL | 2276 |
| AP00064 | P83086, Maximin 7 (toad) | ILGPVLGLVGNALGGLIKNE | 2277 |
| AP00065 | P83087, Maximin 8 (toad) | ILGPVLSLVGNALGGLLKNE | 2278 |
| AP00355 | P83171, Ginkbilobin (Chinese plant) | ANTAFVSSAHNTQKIPAGAPFNRNLRAMLADLRQNAAFAG | 2279 |
| AP00475 | P83188, Pseudin 1 (frog) | GLNTLKKVFQGLHEAIKLINNHVQ | 2280 |
| AP00476 | P83189, Pseudin 2 (frog) | GLNALKKVFQGIHEAIKLINNHVQ | 2281 |
| AP00477 | P83190, Pseudin 3 (frog) | GINTLKKVIQGLHEVIKLVSNHE | 2282 |
| AP00478 | P83191, Pseudin 4 (frog) | GINTLKKVIQGLHEVIKLVSNHA | 2283 |
| AP00410 | P83287, Oncorhyncin III (fish) | SKGKKANKDVELARG | 2284 |
| AP00357 | P83305, Japonicin-1 (amphibian, frog) | FFPIGVFCKIFKTC | 2285 |
| AP00358 | P83306, Japonicin-2 (amphibian, frog) | FGLPMLSILPKALCILLKRKC | 2286 |
| AP00385 | P83312, Parabutoporin (scorpion) | FKLGSFLKKAWKSKLAKKLRAKGKEMLKDYAKGLLEGGSEEVPGQ | 2287 |
| AP00374 | P83313, Opistoporin 1 (scorpion) | GKVWDWIKSTAKKLWNSEPVKELKNTALNAAKNLVAEKIGATPS | 2288 |
| AP00375 | P83314, Opistoporin 2 (scorpion) | GKVWDWIKSTAKKLWNSEPVKELKNTALNAAKNFVAEKIGATPS | 2289 |
| AP00336 | P83327, Histone H2A (fish) | AERVGAGAPVYL | 2290 |
| AP00335 | P83338, Histone H6-like protein (fish) | PKRKSATKGDEPA | 2291 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00411 | P83374, Oncorhyncin II (fish) | KAVAAKKSPKKAKKPAT | 2292 |
| AP00999 | P83375, Serracin-P 43 kDa subunit (bacteria) | DYHHGVRVL | 2293 |
| AP00284 | P83376, Dolabellanin B2 (sea hare) | SHQDCYEALHKCMASHSKPFSCS MKFHMCLQQQ | 2294 |
| AP00998 | P83378, Serracin-P 23 kDa subunit (bacteriocin, bacteria) | ALPKKLKYLNLFNDGFNYMGVV | 2295 |
| AP00129 | P83403, Cecropin (insect, moth) | GWLKKIGKKIERVGQNTRDATVK GLEVAQQAANVAATVR | 2296 |
| AP00127 | P83413, Cecropin A (insect, moth) | RWKVFKKIEKVGRNIRDGVIKAAP AIEVLGQAKAL | 2297 |
| AP00372 | P83416, Virescein (insect) | GKIPIGAIKKAGKAIGKGLRAVNIA STAHDVYTFFKPKKRH | 2298 |
| AP00356 | P83427, Heliocin (insect) | QRFIHPTYRPPPQPRRPVIMRA | 2299 |
| AP00409 | P83428, Locustin (insect) | ATTGCSCPQCIIFDPICASSYKNGRR GFSSGCHMRCYNRCHGTDYFQISK GSKCI | 2300 |
| AP00339 | P83545, Chrysophsin-1 (Red sea bream, madai) | FFGWLIKGAIHAGKAIHGLIHRRRH | 2301 |
| AP00340 | P83546, Chrysophsin-2 (Red sea bream, madai) | FFGWLIRGAIHAGKAIHGLIHRRRH | 2302 |
| AP00341 | P83547, Chrysophsin-3 (Red sea bream, madai) | FIGLLISAGKAIHDLIRRRH | 2303 |
| AP01004 | P84763, Thuricin-S (bacteria) | DWTAWSALVAAACSVELL | 2304 |
| AP00553 | P84868, Sesquin (plant, ZZHp) | KTCENLADTY | 2305 |
| AP00132 | Q06589, Cecropin 1 (insect, fly) | GWLKKIGKKIERVGQHTRDATIQTI AVAQQAANVAATAR | 2306 |
| AP00135 | Q06590, Cecropin 2 (insect fly) | GWLKKIGKKIERVGQHTRDATIQTI GVAQQAANVAATLK | 2307 |
| AP00416 | Q17313, Ceratotoxin C (insect, fly) | SLGGVISGAKKVAKVAIPIGKAVLP VVAKLVG | 2308 |
| AP00171 | Q24395, Metchnikowin (insect) | HRHQGPIFDTRPSPFNPNQPRPGPIY | 2309 |
| AP00354 | Q27023, Tenecin 1 (insect) | VTCDILSVEAKGVKLNDAACAAH CLFRGRSGGYCNGKRVCVCR | 2310 |
| AP00401 | Q28880, Lingual antimicrobial | GFTQGVRNSQSCRRNKGICVPIRCP GSMRQIGTCLGAQVKCCRRK | 2311 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| | peptide (LAP, beta defensin, cow) | | |
| AP00224 | Q62713, RatNP-3 (rat) | CSCRTSSCRFGERLSGACRLNGRIY RLCC | 2312 |
| AP00225 | Q62714, RatNP-4 (rat) | ACYCRIGACVSGERLTGACGLNGR IYRLCCR | 2313 |
| AP00223 | Q62715, RatNP-2 (rat) | VTCYCRSTRCGFRERLSGACGYRG RIYRLCCR | 2314 |
| AP00222 | Q62716, RatNP-1 (rat) | VTCYCRRTRCGFRERLSGACGYRG RIYRLCCR | 2315 |
| AP00174 | Q64365, GNCP-1 (Guinea pig neutrophil cationic peptide 1) | RRCICTTRTCRFPYRRLGTCIFQNR VYTFCC | 2316 |
| AP00311 | Q90W78, Galensin (frog) | CYSAAKYPGFQEFINRKYKSSRF | 2317 |
| AP00395 | Q95NT0, Penaeidin-4a (shrimp, Crustacea) | HSSGYTRPLPKPSRPIFIRPIGCDVC YGIPSSTARLCCFRYGDCCHR | 2318 |
| AP00423 | Q962B0, Penaeidin-3n (shrimp, Crustacea) | QGYKGPYTRPILRPYVRPVVSYNA CTLSCRGITTTQARSCSTRLGRCCH VAKGYS | 2319 |
| AP00422 | Q962B1, Penaeidin-3m (shrimp, Crustacea) | QGCKGPYTRPILRPYVRPVVSYNA CTLSCRGITTTQARSCCTRLGRCCH VAKGYS | 2320 |
| AP00421 | Q963C3, Penaeidin-4C (shrimp, Crustacea) | YSSGYTRPLPKPSRPIFIRPIGCDVC YGIPSSTARLCCFRYGDCCHR | 2321 |
| AP00210 | Q99134, PGLa (African clawed frog, XXA) | GMASKAGAIAGKIAKVALKAL | 2322 |
| AP00054 | Q9DET7, Bombinin-like peptide 7 (BLP-7, toad) | GIGGALLSAGKSALKGLAKGLAEH FAN | 2323 |
| AP00315 | Q9PT75, Dermatoxin (Two-colored leaf frog) | SLGSFLKGVGTTLASVGKVVSDQF GKLLQAGQ | 2324 |
| AP00133 | Q9Y0Y0, Cecropin B (insect, mosquito) | GGLKKLGKKLEGVGKRVFKASEK ALPVLTGYKAIG | 2325 |
| AP00004 | Ref, Ct-AMP1 (CtAMP1, C. ternatea-antimicrobial peptide 1, plant defensin) | NLCERASLTWTGNCGNTGHCDTQ CRNWESAKHGACHKRGNWKCFC YFDC | 2326 |
| AP00027 | Ref, hexapeptide (synthetic) | RRWQWR | 2327 |
| AP00529 | Ref, Lantibiotic Ericin S (bacteria) | WKSESVCTPGCVTGVLQTCFLQTI TCNCHISK | 2328 |
| AP00306 | Ref, Tigerinin-4 (frog) | RVCYAIPLPIC | 2329 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00309 | Ref, Human KS-27 (KS27 from LL-37) | KSKEKIGKEFKRIVQRIKDFLRNLVPR | 2330 |
| AP00344 | Ref, Apidaecin II (honeybee, insect) | GNNRPIYIPQPRPPHPRL | 2331 |
| AP00424 | Ref, XT1 (frog) | GFLGPLLKLAAKGVAKVIPHLIPSRQQ | 2332 |
| AP00425 | Ref, XT 2 (frog) | GCWSTVLGGLKKFAKGGLEAIVNPK | 2333 |
| AP00426 | Ref, XT 4 (frog) | GVFLDALKKFAKGGMNAVLNPK | 2334 |
| AP00427 | Ref, XT 7 (frog) | GLLGPLLKIAAKVGSNLL | 2335 |
| AP00431 | Ref, human LLP 1 | RVIEVVQGACRAIRHIPRRIRQGLERIL | 2336 |
| AP00432 | Ref, human LLP | RIAGYGLRGLAVIIRICIRGLNLIFEIIR | 2337 |
| AP00447 | Ref, Anoplin (insect) | GLLKRIKTLL | 2338 |
| AP00474 | Ref, Piscidin 3 (fish) | FIHHIFRGIVHAGRSIGRFLTG | 2339 |
| AP00481 | Ref, Kaliocin-1 (synthetic) | FFSASCVPGADKGQFPNLCRLCAGTGENKCA | 2340 |
| AP00482 | Ref, Thionin mutation (synthetic) | KSCCRNTWARNCYNVCRLPGTISREICAKKCRCKIISGTTCPSDYPK | 2341 |
| AP00484 | Ref, Stomoxyn (insect, fly) | RGFRKHFNKLVKKVKHTISETAHVAKDTAVIAGSGAAVVAAT | 2342 |
| AP00486 | Ref, Cupiennin 1b (spider) | GFGSLFKFLAKKVAKTVAKQAAKQGAKYIANKQME | 2343 |
| AP00487 | Ref, Cupiennin 1c (spider) | GFGSLFKFLAKKVAKTVAKQAAKQGAKYIANKQTE | 2344 |
| AP00488 | Ref, Cupiennin 1D (spider) | GFGSLFKFLAKKVAKTVAKQAAKQGAKYVANKHME | 2345 |
| AP00489 | Ref, Hipposin (fish) | SGRGKTGGKARAKAKTRSSRAGLQFPVGRVHRLLRKGNYAHRVGAGAPVYL | 2346 |
| AP00923 | Ref, Carnobacteriocin B1 (XXO, class IIa bacteriocin, bacteria) | AISYGNGVYCNKEKCWVNKAENKQAITGIVIGGWASSLAGMGH | 2347 |
| AP00496 | Ref, HP 2-20 (synthetic) | AKKVFKRLEKLFSKIQNDK | 2348 |
| AP00497 | Ref, Maximin H5 (toad) | ILGPVLGLVSDTLDDVLGIL | 2349 |
| AP00498 | Ref, rCRAMP (rat cathelicidin) | GLVRKGGEKFGEKLRKIGQKIKEFFQKLALEIEQ | 2350 |
| AP00500 | Ref, S9-P18 (synthetic) | KWKLFKKISKFLHLAKKF | 2351 |
| AP00501 | Ref, L9-P18 (synthetic) | KWKLFKKILKFLHLAKKF | 2352 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00502 | Ref, Clavaspirin (sea squirt, tunicate) | FLRFIGSVIHGIGHLVHHIGVAL | 2353 |
| AP00503 | Ref, human P-113D | AKRHHGYKRKFH | 2354 |
| AP00504 | Ref, human MUC7 20-Mer | LAHQKPFIRKSYKCLHKRCR | 2355 |
| AP00507 | Ref, Nigrocin 2 (frog) | GLLSKVLGVGKKVLCGVSGLC | 2356 |
| AP00508 | Ref, Nigrocin 1 (frog) | GLLDSIKGMAISAGKGALQNLLKVASCKLDKTC | 2357 |
| AP00509 | Ref, human Calcitermin | VAIALKAAHYHTHKE | 2358 |
| AP00510 | Ref, Dicynthaurin (sea peach) | ILQKAVLDCLKAAGSSLSKAAITAIYNKIT | 2359 |
| AP00511 | Ref, KIGAKI (synthetic) | KIGAKIKIGAKIKIGAKI | 2360 |
| AP00516 | Ref, Lycotoxin I (spider) | IWLTALKFLGKHAAKHLAKQQLSKL | 2361 |
| AP00517 | Ref, Lycotoxin II (spider) | KIKWFKTMKSIAKFIAKEQMKKHLGGE | 2362 |
| AP00518 | Ref, Ib-AMP3 (plant defensin, balsam) | QYRHRCCAWGPGRKYCKRWC | 2363 |
| AP00519 | Ref, Ib-AMP4 (plant defensin, balsam) | EWGRRCCGWGPGRRYCRRWC | 2364 |
| AP00521 | Ref, Dhvar4 (synthetic) | KRLFKKLLFSLRKY | 2365 |
| AP00522 | Ref, Dhvar5 (synthetic) | LLLFLLKKRKKRKY | 2366 |
| AP00525 | Ref, Maximin H2 (toad) | ILGPVLSMVGSALGGLIKKI | 2367 |
| AP00526 | Ref, Maximin H3 (toad) | ILGPVLGLVGNALGGLIKKI | 2368 |
| AP00527 | Ref, Maximin H4 (toad) | ILGPVISKIGGVLGGLLKNL | 2369 |
| AP00528 | Ref, Anionic peptide SAAP (sheep) | DDDDDD | 2370 |
| AP00530 | Ref, Lantibiotic Ericin A (bacteria) | VLSKSLCTPGCITGPLQTCYLCFPTFAKC | 2371 |
| AP00531 | Ref, Kenojeinin I (sea skate) | GKQYFPKVGGRLSGKAPLAAKTHRRLKP | 2372 |
| AP00532 | Ref, Lunatusin (plant, ZZHp) | KTCENLADTFRGPCFATSNC | 2373 |
| AP00533 | Ref, Fallaxin (frog) | GVVDILKGAAKDIAGHLASKVMNKL | 2374 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00534 | Ref, Tu-AMP 2 (TuAMP2, thionin-like antimicrobial peptides, plant defensin, tulip) | KSCCRNTTARNCYNVCRIPG | 2375 |
| AP00535 | Ref, Pilosulin 1 (Myr b I) (Australian ants) | GLGSVFGRLARILGRVIPKVAKKL GPKVAKVLPKVMKEAIPMAVEMA KSQEEQQPQ | 2376 |
| AP00536 | Ref, Luxuriosin (insect) | SVRTQDNAVNRQIFGSNGPYRDFQ LSDCYLPLETNPYCNEWQFAYHW NNALMDCERAIYHGCNRTRNNFIT LTACKNQAGPICNRRRH | 2377 |
| AP00537 | Ref, SAMP H1 (fish, Atlantic salmon) | AEVAPAPAAAAPAKAPKKKAAAK PKKAGPS | 2378 |
| AP00538 | Ref, Halocidin (dimer Hal18 + Hal15) (tunicate) | WLNALLHHGLNCAKGVLA | 2379 |
| AP00539 | Ref, AOD (American oyster defensin, animal defensin) | GFGCPWNRYQCHSHCRSIGRLGGY CAGSLRLTCTCYRS | 2380 |
| AP00540 | Ref, Pentadactylin (frog) | GLLDTLKGAAKNVVGSLASKVME KL | 2381 |
| AP00541 | Ref, Polybia-MPI (insect, social wasp) | IDWKKLLDAAKQIL | 2382 |
| AP00542 | Ref, Polybia-CP (insect, social wasp) | ILGTILGLLKSL | 2383 |
| AP00543 | Ref, Ocellatin-1 (XXA, frog) | GVVDILKGAGKDLLAHLVGKISEKV | 2384 |
| AP00544 | Ref, Ocellatin-2 (XXA, frog) | GVLDIFKDAAKQILAHAAEKQI | 2385 |
| AP00545 | Ref, Ocellatin-3 (frog) | GVLDILKNAAKNILAHAAEQI | 2386 |
| AP00548 | Ref, CMAP 27 (chicken myeloid antimicrobial peptide 27, bird cathelicidin, chicken cathelicidin) | RFGRFLRKIRRFRPKVTITIQGSARFG | 2387 |
| AP00550 | Ref, Tu-AMP-1 (TuAMP1, thionin-like antimicrobial peptides, plant defensin, tulip) | KSCCRNTVARNCYNVCRIPGTPRP VCAATCDCKLITGTKCPPGYEK | 2388 |
| AP00551 | Ref, Combi-2 (synthetic) | FRWWHR | 2389 |
| AP00552 | Ref, Maximin 9 (frog) | GIGRKFLGGVKTTFRCGVKDFASK HLY | 2390 |
| AP00554 | Ref, S1 moricin (insect) | GKIPVKAIKKAGAAIGKGLRAINIA STAHDVYSFFKPKHKKK | 2391 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00555 | Ref, Parasin I (catfish) | KGRGKQGGKVRAKAKTRSS | 2392 |
| AP00556 | Ref, Kassinatuerin-1 (frog) | GFMKYIGPLIPHAVKAISDLI | 2393 |
| AP00557 | Ref, Fowlicidin-1 (chCATH-1, bird cathelicidin, chicken cathelicidin) | RVKRVWPLVIRTVIAGYNLYRAIKKK | 2394 |
| AP00559 | Ref, Eryngin (mushroom, fungi) | ATRVVYCNRRSGSVVGGDDTVYYEG | 2395 |
| AP00560 | Ref, Dendrocin (plant, bamboo) | TTLTLHNLCPYPVWWLVTPNNGGFPIIDNTPVVLG | 2396 |
| AP00561 | Ref, Coconut antifungal peptide (plant) | EQCREEEDDR | 2397 |
| AP00562 | Ref, Pandinin 1 (African scorpion) | GKVWDWIKSAAKKIWSSEPVSQLKGQVLNAAKNYVAEKIGATPT | 2398 |
| AP00563 | Ref, White cloud bean defensin (plant defensin) | KTCENLADTFRGPCFATSNCDDHCKNKEHLLSGRCRDDFRCWCTRNC | 2399 |
| AP00564 | Ref, Dybowskin-1 (frog) | FLIGMTHGLICLISRKC | 2400 |
| AP00565 | Ref, Dybowskin-2 (frog) | FLIGMTQGLICLITRKC | 2401 |
| AP00566 | Ref, Dybowskin-3 (frog) | GLFDVVKGVLKGVGKNVAGSLLEQLKCKLSGGC | 2402 |
| AP00567 | Ref, Dybowskin-4 (frog) | VWPLGLVICKALKIC | 2403 |
| AP00568 | Ref, Dybowskin-5 (frog) | GLFSVVTGVLKAVGKNVAKNVGGSLLEQLKCKKISGGC | 2404 |
| AP00569 | Ref, Dybowskin-6 (frog) | FLPLLLAGLPLKLCFLFKKC | 2405 |
| AP00570 | Ref, Pleurain-A1 (frog) | SIITMTKEAKLPQLWKQIACRLYNTC | 2406 |
| AP00571 | Ref, Pleurain-A2 (frog) | SIITMTKEAKLPQSWKQIACRLYNTC | 2407 |
| AP00574 | Ref, Esculentin-1GRa (frog) | GLFSKFAGKGIKNLIFKGVKHIGKEVGMDVIRTGIDVAGCKIKGEC | 2408 |
| AP00575 | Ref, Brevinin-2GRa (frog) | GLLDTFKNLALNAAKSAGVSVLNSLSCKLSKTC | 2409 |
| AP00576 | Ref, Brevinin-2GRb (frog) | GVLGTVKNLLIGAGKSAAQSVLKTLSCKLSNDC | 2410 |
| AP00577 | Ref, Brevinin-2GRc (frog) | GLFTLIKGAAKLIGKTVAKEAGKTGLELMACKITNQC | 2411 |
| AP00578 | Ref, Brevinin-1GRa (frog) | FLPLLAGLAANFLPKIFCKITKKC | 2412 |
| AP00579 | Ref, Nigrocin-2GRa (frog) | GLLSGILGAGKHIVCGLSGLC | 2413 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00580 | Ref, Nigrocin-2GRb (frog) | GLFGKILGVGKKVLCGLSGMC | 2414 |
| AP00581 | Ref, Nigrocin-2GRc (frog) | GLLSGILGAGKNIVCGLSGLC | 2415 |
| AP00582 | Ref, Brevinin-2GHa (frog) | GFSSLFKAGAKYLLKSVGKAGAQ QLACKAANNCA | 2416 |
| AP00583 | Ref, Brevinin-2GHb (frog) | GVITDALKGAAKTVAAELLRKAH CKLTNSC | 2417 |
| AP00584 | Ref, Guentherin (frog) | VIDDLKKVAKKVRRELLCKKHHK KLN | 2418 |
| AP00585 | Ref, Brevinin-2GHc (frog) | SIWEGIKNAGKGFLVSILDKVRCK VAGGCNP | 2419 |
| AP00586 | Ref, Temporin-GH (frog) | FLPLLFGAISHLL | 2420 |
| AP00587 | Ref, Brevinin-2TSa (frog) | GIMSLFKGVLKTAGKHVAGSLVD QLKCKITGGC | 2421 |
| AP00588 | Ref, Brevinin-1TSa (frog) | FLGSIVGALASALPSLISKIRN | 2422 |
| AP00589 | Ref, Temporin-1TSa (frog) | FLGALAKIISGIF | 2423 |
| AP00593 | Ref, Brevinin-1CSa (frog) | FLPILAGLAAKIVPKLFCLATKKC | 2424 |
| AP00594 | Ref, Temporin-1CSa (frog) | FLPIVGKLLSGLL | 2425 |
| AP00595 | Ref, Temporin-1CSb (frog) | FLPIIGKLLSGLL | 2426 |
| AP00596 | Ref, Temporin-1CSc (frog) | FLPLVTGLLSGLL | 2427 |
| AP00597 | Ref, Temporin-1CSd (frog) | NFLGTLVNLAKKIL | 2428 |
| AP00598 | Ref, Temporin-1SPb (frog) | FLSAITSLLGKLL | 2429 |
| AP00599 | Ref, Brevinin-2-related (frog) | GIWDTIKSMGKVFAGKILQNL | 2430 |
| AP00600 | Ref, Odorranain-HP (frog) | GLLRASSVWGRKYYVDLAGCAKA | 2431 |
| AP00601 | Ref, Brevinin-1DYa (frog) | FLSLALAALPKFLCLVFKKC | 2432 |
| AP00602 | Ref, Brevinin-1DYb (frog) | FLSLALAALPKLFCLIFKKC | 2433 |
| AP00603 | Ref, Brevinin-1DYc (frog) | FLPLLLAGLPKLLCLFFKKC | 2434 |
| AP00607 | Ref, Brevinin-2DYb (frog) | GLFDVVKGVLKGAGKNVAGSLLE QLKCKLSGGC | 2435 |
| AP00608 | Ref, Brevinin-2DYc (frog) | GLFDVVKGVLKGVGKNVAGSLLE QLKCKLSGGC | 2436 |
| AP00609 | Ref, Brevinin-2DYd (frog) | GIFDVVKGVLKGVGKNVAGSLLE QLKCKLSGGC | 2437 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00610 | Ref, Brevinin-2DYe (frog) | GLFSVVTGVLKAVGKNVAKNVGG SLLEQLKCKISGGC | 2438 |
| AP00611 | Ref, Temporin-1DYa (frog) | FIGPIISALASLFG | 2439 |
| AP00615 | Ref, Palustrin-1b (frog) | ALFSILRGLKKLGNMGQAFVNCKI YKKC | 2440 |
| AP00616 | Ref, Palustrin-1c (frog) | ALSILRGLEKLAKMGIALTNCKAT KKC | 2441 |
| AP00617 | Ref, Palustrin-1d (frog) | ALSILKGLEKLAKMGIALTNCKAT KKC | 2442 |
| AP00619 | Ref, Palustrin-2b (frog) | GFFSTVKNLATNVAGTVIDTLKCK VTGGCRS | 2443 |
| AP00620 | Ref, Palustrin-2c (frog) | GFLSTVKNLATNVAGTVIDTLKCK VTGGCRS | 2444 |
| AP00621 | Ref, Palustrin-3a (frog) | GIFPKIIGKGIKTGIVNGIKSLVKGV GMKVFKAGLNNIGNTGCNEDEC | 2445 |
| AP00622 | Ref, Palustrin-3b (frog) | GIFPKIIGKGIKTGIVNGIKSLVKGV GMKVFKAGLSNIGNTGCNEDEC | 2446 |
| AP00624 | Ref, human ALL-38 (an LL-37 analog released from its precursor hCAP-18 by gastricsin in vivo) | ALLGDFFRKSKEKIGKEFKRIVQRI KDFLRNLVPRTES | 2447 |
| AP00625 | Ref, human KR-20 (KR20 from LL-37) | KRIVQRIKDFLRNLVPRTES | 2448 |
| AP00626 | Ref, human KS-30 (KS30 from LL-37) | KSKEKIGKEFKRIVQRIKDFLRNLV PRTES | 2449 |
| AP00627 | Ref, human RK-31 (RK31 from LL-37) | RKSKEKIGKEFKRIVQRIKDFLRNL VPRTES | 2450 |
| AP00628 | Ref, human LL-23 (LL23 from LL-37) | LLGDFFRKSKEKIGKEFKRIVQR | 2451 |
| AP00629 | Ref, human LL-29 (LL29 from LL-37) | LLGDFFRKSKEKIGKEFKRIVQRIK DFLR | 2452 |
| AP00630 | Ref, Amoeba peptide (protozoan para | GEILCNLCTGLINTLENLLTTKGAD | 2453 |
| AP00631 | Ref, Mundticin (bacteria) | KYYGNGVSCNKKGCSVDWGKAIG IIGNNSAANLATGGAAGWSK | 2454 |
| AP00638 | Ref, Citropin 2.1 (frog) | GLIGSIGKALGGLLVDVLKPKL | 2455 |
| AP00639 | Ref, Citropin 2.1.3 (frog) | GLIGSIGKALGGLLVDVLKPKLQA AS | 2456 |
| AP00640 | Ref, Maculatin 1.3 (frog) | GLLGLLGSVVSHVVPAIVGHF | 2457 |
| AP00641 | Ref, Pardaxin 1 (Pardaxin P-1, Pardaxin P1, Pa1, flat fish) | GFFALIPKIISSPLFKTLLSAVGSALS SSGEQE | 2458 |

TABLE 14-continued

Other illustrative antimicrobial peptides. AP numbers refer to ID in antimicrobial peptide database (http://aps.unmc.edu/AP/main.php).

| Effector | | Structure/Sequence | SEQ ID No |
|---|---|---|---|
| AP00642 | Ref, Pardaxin 2 (Pardaxin P-2, Pardaxin P2, Pa2, flat fish) | GFFALIPKIISSPIFKTLLSAVGSALS SSGGQE | 2459 |
| AP00643 | Ref, Pardaxin 3 (Pardaxin P-3, Pardaxin P3, Pa3, flat fish) | GFFAFIPKIISSPLFKTLLSAVGSALS SSGEQE | 2460 |
| AP00645 | Ref, Pardaxin 5 (Pardaxin P-5, Pardaxin P5, Pa5, flat fish) | GFFAFIPKIISSPLFKTLLSAVGSALS SSGDQE | 2461 |
| AP00647 | Ref, Brevinin-1PLb (frog) | FLPLIAGLAANFLPKIFCAITKKC | 2462 |
| AP00648 | Ref, Brevinin-1PLc (frog) | FLPVIAGVAAKFLPKIFCAITKKC | 2463 |
| AP00649 | Ref, Esculentin-1PLa (frog) | GLFPKINKKKAKTGVFNIIKTVGKE AGMDLIRTGIDTIGCKIKGEC | 2464 |
| AP00650 | Ref, Esculentin-1PLb (frog) | GIFTKINKKKAKTGVFNIIKTIGKEA GMDVIRAGIDTISCKIKGEC | 2465 |
| AP00651 | Ref, Esculentin-2PLa (frog) | GLFSILKGVGKIALKGLAKNMGK MGLDLVSCKISKEC | 2466 |
| AP00652 | Ref, Ranatuerin-2PLa (frog) | GIMDTVKNVAKNLAGQLLDKLKC KITAC | 2467 |
| AP00653 | Ref, Ranatuerin-2PLb (frog) | GIMDTVKNAAKDLAGQLLDKLKC RITGC | 2468 |
| AP00654 | Ref, Ranatuerin-2PLc (frog) | GLLDTIKNTAKNLAVGLLDKIKCK MTGC | 2469 |
| AP00655 | Ref, Ranatuerin-2PLd (frog) | GIMDSVKNVAKNIAGQLLDKLKC KITGC | 2470 |
| AP00656 | Ref, Ranatuerin-2PLe (frog) | GIMDSVKNAAKNLAGQLLDTIKCK ITAC | 2471 |
| AP00657 | Ref, Ranatuerin-2PLf (frog) | GIMDTVKNAAKDLAGQLDKLKCR ITGC | 2472 |
| AP00658 | Ref, Temporin-1PLa (frog) | FLPLVGKILSGLI | 2473 |
| AP00659 | Ref, Ranatuerin 5 (frog) | FLPIASLLGKYL | 2474 |
| AP00661 | Ref, Esculentin-2L (frog) | GILSLFTGGIKALGKTLFKMAGKA GAEHLACKATNQC | 2475 |
| AP00662 | Ref, Esculentin-2B (ESC2B-RANBE, frog) | GLFSILRGAAKFASKGLGKDLTKL GVDLVACKISKQC | 2476 |
| AP00663 | Ref, Esculentin-2P (frog) | GFSSIFRGVAKFASKGLGKDLARL GVNLVACKISKQC | 2477 |
| AP00664 | Ref, Peptide A1 (frog) | FLPAIAGILSQLF | 2478 |
| AP00665 | Ref, Peptide B9 (frog) | FLPLIAGLIGKLF | 2479 |

TABLE 14-continued

Other illustrative antimicrobial peptides. AP numbers refer to ID in antimicrobial peptide database (http://aps.unmc.edu/AP/main.php).

| Effector | | Structure/Sequence | SEQ ID No |
|---|---|---|---|
| AP00666 | Ref, PG-L (frog) | EGGGPQWAVGHFM | 2480 |
| AP00667 | Ref, PG-KI (frog) | EPHPDEFVGLM | 2481 |
| AP00668 | Ref, PG-KII (frog) | EPNPDEFVGLM | 2482 |
| AP00669 | Ref, PG-KIII (frog) | EPHPNEFVGLM | 2483 |
| AP00670 | Ref, PG-SPI (frog) | EPNPDEFFGLM | 2484 |
| AP00660 | Ref, Pandinin 2 (African scorpion) | FWGALAKGALKLIPSLFSSFSKKD | 2485 |
| AP00671 | Ref, PG-SPII (frog) | EPNPNEFFGLM | 2486 |
| AP00673 | Ref, Lantibiotic Ericin S (bacteria | WKSESVCTPGCVTGVLQTCFLQTITCNCHISK | 2487 |
| AP00674 | Ref, Lantibiotic Ericin A (bacteria | VLSKSLCTPGCITGPLQTCYLCFPTFAKC | 2488 |
| AP00675 | Ref, Human beta defensin 4 (HBD-4, HBD4, human defensin) | FELDRICGYGTARCRKKCRSQEYRIGRCPNTYACCLRKWDESLLNRTKP | 2489 |
| AP00676 | Ref, RL-37 (RL37, monkey cathelicidin) | RLGNFFRKVKEKIGGGLKKVGQKIKDFLGNLVPRTAS | 2490 |
| AP00677 | Ref, CAP11 (Guinea pig cathelicidin) | GLRKKFRKTRKRIQKLGRKIGKTGRKVWKAWREYGQIPYPCRI | 2491 |
| AP00678 | Ref, Canine cathelicidin (K9CATH) (dog) | RLKELITTGGQKIGEKIRRIGQRIKDFFKNLQPREEKS | 2492 |
| AP00679 | Ref, Esculentin 2VEb (frog) | GLFSILKGVGKIAIKGLGKNLGKMGLDLVSCKISKEC | 2493 |
| AP00680 | Ref, SMAP-34 (sheep cathelicidin) | GLFGRLRDSLQRGGQKILEKAERIWCKIKDIFR | 2494 |
| AP00681 | Ref, OaBac5 (sheep cathelicidin) | RFRPPIRRPPIRPPFRPPFRPPVRPPIRPPFRPPFRPPIGPFP | 2495 |
| AP00682 | Ref, OaBac6 (sheep cathelicidin) | RRLRPRHQHFPSERPWPKPLPLPRPGPRPWPKPLPLPLPRPGLRPWPKPL | 2496 |
| AP00683 | Ref, OaBac7.5 (sheep cathelicidin) | RRLRPRRPRLPRPRPRPRPRSLPLPRPQPRRIPRPILLPWRPPRPIPRPQIQPIPRWL | 2497 |
| AP00684 | Ref, OaBac11 (sheep cathelicidin) | RRLRPRRPRLPRPRPRPRPRSLPLPRPKPRPIPRPLPLPRPRPKPIPRPLPLPRPRPRRIPRPLPLPRPRPRPIPRPLPLPQPQPSPIPRPL | 2498 |
| AP00685 | Ref, Ranatuerin 2VEb (frog) | GIMDTVKGVAKTVAASLLDKLKCKITGC | 2499 |
| AP00686 | Ref, eCATH-1 (horse cathelicidin) | KRFGRLAKSFLRMRILLPRRKILLAS | 2500 |
| AP00687 | Ref, eCATH-2 (horse cathelicidin) | KRRHWFPLSFQEFLEQLRRFRDQLPFP | 2501 |
| AP00688 | Ref, eCATH-3 (horse cathelicidin) | KRFHSVGSLIQRHQQMIRDKSEATRHGIRIITRPKLLLAS | 2502 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00689 | Ref, Prophenin-1 (pig cathelicidin) | AFPPPNVPGPRFPPPNFPGPRFPPPN FPGPRFPPPNFPGPRFPPPNFPGPPFP PPIFPGPWFPPPPPFRPPPFGPPRFP | 2503 |
| AP00690 | Ref, Prophenin-2 (pig cathelicidin) | AFPPPNVPGPRFPPPNVPGPRFPPPN FPGPRFPPPNFPGPRFPPPNFPGPPFP PPIFPGPWFPPPPPFRPPPFGPPRFP | 2504 |
| AP00691 | Ref, HFIAP-1 (hagfish cathelicidin) | GFFKKAWRKVKHAGRRVLDTAK GVGRHYVNNWLNRYR | 2505 |
| AP00692 | Ref, HFIAP-3 (hagfish cathelicidin) | GWFKKAWRKVKNAGRRVLKGVG IHYGVGLI | 2506 |
| AP00693 | Ref, Trout cath (fish cathelicidin) | RICSRDKNCVSRPGVGSIIGRPGGG SLIGRPGGGSVIGRPGGGSPPGGGS FNDEFIRDHSDGNRFA | 2507 |
| AP00694 | Ref, MRP (melittin-related peptide) | AIGSILGALAKGLPTLISWIKNR | 2508 |
| AP00695 | Ref, Temporin-1TGa (frog) | FLPILGKLLSGIL | 2509 |
| AP00696 | Ref, Dahlein 1.1 (frog) | GLFDIIKNIVSTL | 2510 |
| AP00697 | Ref, Dahlein 1.2 (frog) | GLFDIIKNIFSGL | 2511 |
| AP00698 | Ref, Dahlein 4.1 (frog) | GLWQLIKDKIKDAATGFVTGIQS | 2512 |
| AP00699 | Ref, Dahlein 4.2 (frog) | GLWQFIKDKLKDAATGLVTGIQS | 2513 |
| AP00700 | Ref, Dahlein 4.3 (frog) | GLWQFIKDKFKDAATGLVTGIQS | 2514 |
| AP00701 | Ref, Dahlein 5.1 (frog) | GLLGSIGNAIGAFIANKLKP | 2515 |
| AP00702 | Ref, Dahlein 5.2 (frog) | GLLGSIGNAIGAFIANKLKPK | 2516 |
| AP00703 | Ref, Dahlein 5.3 (frog) | GLLASLGKVLGGYLAEKLKP | 2517 |
| AP00704 | Ref, Dahlein 5.4 (frog) | GLLGSIGKVLGGYLAEKLKPK | 2518 |
| AP00705 | Ref, Dahlein 5.5 (frog) | GLLASLGKVLGGYLAEKLKPK | 2519 |
| AP00706 | Ref, Dahlein 5.6 (frog) | GLLASLGKVFGGYLAEKLKPK | 2520 |
| AP00709 | Ref, *Mytilus* defensin (mytilin) A (mollusc) | GFGCPNDYPCHRHCKSIPGRAGGY CGGAHRLRCTCYR | 2521 |
| AP00711 | Ref, Mussel defensin MGD2 | GFGCPNNYACHQHCKSIRGYCGG YCAGWFRLRCTCYRCG | 2522 |
| AP00712 | Ref, scorpion defensin | GFGCPLNQGACHRHCRSIRRRGGY CAGFFKQTCCYRN | 2523 |

TABLE 14-continued

Other illustrative antimicrobial peptides. AP numbers refer to ID in antimicrobial peptide database (http://aps.unmc.edu/AP/main.php).

| Effector | | Structure/Sequence | SEQ ID No |
|---|---|---|---|
| AP00713 | Ref, *Androctonus* defensin | GFGCPFNQGACHRHCRSIRRRGGY CAGLFKQTCTCYR | 2524 |
| AP00714 | Ref, *Orinthodoros* defensin A (soft ticks) | GYGCPFNQYQCHSHCSGIRGYKGG YCKGTFKQTCKCY | 2525 |
| AP00715 | Ref, VaD1 (plant defensin) | RTCMKKEGWGKCLIDTTCAHSCK NRGYIGGNCKGMTRTCYCLVNC | 2526 |
| AP00722 | Ref, Cryptonin (insect, cicada) | GLLNGLALRLGKRALKKIIKRLCR | 2527 |
| AP00723 | Ref, Decoralin (insect) | SLLSLLRKLIT | 2528 |
| AP00724 | Ref, RTD-2 (rhesus theta-defensin-2, minidefensin, XXC, BBS, lectin, ZZHa) | RCLCRRGVCRCLCRRGVC | 2529 |
| AP00725 | Ref, RTD-3 (rhesus theta-defensin-3, minidefensin, XXC, BBS, lectin, ZZHa) | RCICTRGFCRCICTRGFC | 2530 |
| AP00726 | Ref, Combi-1 (synthetic) | RRWWRF | 2531 |
| AP00748 | Ref, Gm pro-rich pept1 (insect) | DIQIPGIKKPTHRDIIIPNWNPNVRT QPWQRFGGNKS | 2532 |
| AP00749 | Ref, Gm anionic pept 1 (insect) | EADEPLWLYKGDNIERAPTTADHP ILPSIIDDVKLDPNRRYA | 2533 |
| AP00750 | Ref, Gm pro-rich pept 2 (insect) | EIRLPEPFRFPSPTVPKPIDIDPILPHP WSPRQTYPIIARRS | 2534 |
| AP00752 | Ref, Gm defensin-like peptide (insect) | DKLIGSCVWGATNYTSDCNAECK RRGYKGGHCGSFWNVNCWCEE | 2535 |
| AP00753 | Ref, Gm apolipophoricin (insect) | VQETQKLAKTVGANLEETNKKLA PQIKSAYDDFVKQAQEVQKKLHE AASKQ | 2536 |
| AP00754 | Ref, Gm anionic pept2 (insect) | ETESTPDYLKNIQQQLEEYTKNFNT QVQNAFDSDKIKSEVNNFIESLGKI LNTEKKEAPK | 2537 |
| AP00755 | Ref, Gm cecropin D-like pept, insect | ENFFKEIERAGQRIRDAIISAAPAVE TLAQAQKIIKGGD | 2538 |
| AP00756 | Ref, Dermaseptin-B6 (DRS-B6, DRS B6, XXA, frog) | ALWKDILKNAGKAALNEINQLVNQ | 2539 |
| AP00759 | Ref, Phylloseptin-01 (PLS-O1, Phylloseptin-4, PS-4, XXA, frog) | FLSLIPHAINAVSTLVHHSG | 2540 |
| AP00760 | Ref, Phylloseptin-02 (PLS-O2, Phylloseptin-5, PS-5, XXA, frog) | FLSLIPHAINAVSAIAKHS | 2541 |
| AP00761 | Ref, Phylloseptin-6 (Phylloseptin-H4, | SLIPHAINAVSAIAKHF | 2542 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| | PLS-H4, PS-6, XXA, frog) | | |
| AP00762 | Ref, Phylloseptin-7 (Phylloseptin-H5, PLS-H5, PS-7, XXA, frog) | FLSLIPHAINAVSAIAKHF | 2543 |
| AP00763 | Ref, Dermaseptin DPh-1 (XXA, frog) | GLWSTIKNVGKEAAIAAGKAALGAL | 2544 |
| AP00764 | Ref, Dermaseptin-S9 (DRS-S9, DRS S9, frog) | GLRSKIWLWVLLMIWQESNKFKKM | 2545 |
| AP00765 | Ref, Human salvic | MHDFWVLWVLLEYIYNSACSVLSATSSVSSRVLNRSLQVKVVKITN | 2546 |
| AP00766 | Ref, Gassericin A (XXC, XXD2, class IV bacteriocin, Gram-positive bacteria) | IYWIADQFGIHLATGTARKLLDAMASGASLGTAFAAILGVTLPAWALAAAGALGATAA | 2547 |
| AP00767 | Ref, Circularin A (XXC, class IV bacteriocin, Gram-positive bacteria) | VAGALGVQTAAATTIVNVILNAGTLVTVLGIIASIASGGAGTLMTIGWATFKATVQKLAKQSMARAIAY | 2548 |
| AP00768 | Ref, Closticin 574 (bacteria) | PNWTKIGKCAGSIAWAIGSGLFGGAKLIKIKKYIAELGGLQKAAKLLVGATTWEEKLHAGGYALINLAAELTGVAGIQANCF | 2549 |
| AP00769 | Ref, Caerin 1.11 (XXA, frog) | GLLGAMFKVASKVLPHVVPAITEHF | 2550 |
| AP00770 | Ref, Maculatin 1.4 (XXA, frog) | GLLGLLGSVVSHVLPAITQHL | 2551 |
| AP00771 | Ref, Magainin 1 (frog) | GIGKFLHSAGKFGKAFVGEIMKS | 2552 |
| AP00772 | Ref, Oxyopinin 1 (spider) | FRGLAKLLKIGLKSFARVLKKVLPKAAKAGKALAKSMADENAIRQQNQ | 2553 |
| AP00773 | Ref, Oxyopinin 2a (spider) | GKFSVFGKILRSIAKVFKGVGKVRKQFKTASDLDKNQ | 2554 |
| AP00774 | Ref, Oxyopinin 2b (spider) | GKFSGFAKILKSIAKFFKGVGKVRKGFKEASDLDKNQ | 2555 |
| AP00775 | Ref, Oxyopinin 2c (spider) | GKLSGISKVLRAIAKFFKGVGKARKQFKEASDLDKNQ | 2556 |
| AP00776 | Ref, Oxyopinin 2d (spider) | GKFSVFSKILRSIAKVFKGVGKVRKGFKTASDLDKNQ | 2557 |
| AP00777 | Ref, NRC-1 (XXA, fish, gene predicted) | GKGRWLERIGKAGGIIGGALDHL | 2558 |
| AP00778 | Ref, NRC-2 (XXA, fish, gene predicted) | WLRRIGKGVKIIGGAALDHL | 2559 |
| AP00779 | Ref, NRC-3 (XXA, fish, gene predicted) | GRRKRKWLRRIGKGVKIIGGAALDHL | 2560 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00781 | Ref, NRC-5 (XXA, fish, gene predicted) | FLGALIKGAIHGGRFIHGMIQNHH | 2561 |
| AP00782 | Ref, NRC-6 (XXA, fish, gene predicted) | GWGSIFKHGRHAAKHIGHAAVNHYL | 2562 |
| AP00783 | Ref, NRC-7 (XXA, fish, gene predicted) | RWGKWFKKATHVGKHVGKAALTAYL | 2563 |
| AP00784 | Ref, NRC-10 (XXA, fish, gene predicted) | FFRLLFHGVHHVGKIKPRA | 2564 |
| AP00785 | Ref, NRC-11 (XXA, fish, gene predicted) | GWKSVFRKAKKVGKTVGGLALDHYL | 2565 |
| AP00786 | Ref, NRC-12 (XXA, fish, gene predicted) | GWKKWFNRAKKVGKTVGGLAVDHYL | 2566 |
| AP00787 | Ref, NRC-13 (XXA, fish, gene predicted) | GWRLLLKKAEVKTVGKLALKHYL | 2567 |
| AP00788 | Ref, NRC-14 (XXA, fish, gene predicted) | AGWGSIFKHIFKAGKFIHGAIQAHND | 2568 |
| AP00789 | Ref, NRC-15 (XXA, fish, gene predicted) | GFWGKLFKLGLHGIGLLHLHL | 2569 |
| AP00790 | Ref, NRC-16 (XXA, fish, gene predicted) | GWKKWLRKGAKHLGQAAIK | 2570 |
| AP00791 | Ref, NRC-17 (XXA, fish, gene predicted) | GWKKWLRKGAKHLGQAAIKGLAS | 2571 |
| AP00792 | Ref, NRC-19 (XXA, fish, gene predicted) | FLGLLFHGVHHVGKWIHGLIHGHH | 2572 |
| AP00793 | Ref, Bombinin H2 (XXA, frog) | IIGPVLGLVGSALGGLLKKI | 2573 |
| AP00794 | Ref, Bombinin H3 (frog, XXD, XXA) | IIGPVLGMVGSALGGLLKKI | 2574 |
| AP00795 | Ref, Bombinin H7 (frog, XXD, XXA) | ILGPILGLVSNALGGLL | 2575 |
| AP00796 | Ref, Bombinin GH-1L (XXA, toad) | IIGPVLGLVGKPLESLLE | 2576 |
| AP00797 | Ref, Bombinin GH-1D (toad, XXD, XXA) | IIGPVLGLVGKPLESLLE | 2577 |
| AP00807 | Ref, Enterocin E-760 (bacteriocin, bacteria) | NRWYCNSAAGGVGGAAGCVLAGYVGEAKENIAGEVRKGWGMAGGFTHNKACKSFPGSGWASG | 2578 |
| AP00808 | Ref, hepcidin (fish) | CRFCCRCCPRMRGCGLCCRF | 2579 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00809 | Ref, hepcidin TH1-5 (fish) | GIKCRFCCGCCTPGICGVCCRF | 2580 |
| AP00810 | Ref, hepcidin TH2-3 (fish) | QSHLSLCRWCCNCCRSNKGC | 2581 |
| AP00811 | Ref, human LEAP-2 | MTPFWRGVSLRPIGASCRDDSECIT RLCRKRRCSLSVAQE | 2582 |
| AP00812 | Ref, Enkelytin (cow) | FAEPLPSEEEGESYSKEPPEMEKRY GGFM | 2583 |
| AP00732 | Ref, Spheniscin-1 (Sphe-1, avian defensin) | SFGLCRLRRGSCAHGRCRFPSIPIG RCSRFVQCCRRVW | 2584 |
| AP00733 | Ref, Organgutan ppyLL-37 (Great Ape, primate cathelicidin) | LLGDFFRKAREKIGEEFKRIVQRIK DFLRNLVPRTES | 2585 |
| AP00734 | Ref, Gibbon hmdSL-37 (hylobatidae, primate cathelicidin) | SLGNFFRKARKKIGEEFKRIVQRIK DFLQHLIPRTEA | 2586 |
| AP00735 | Ref, pobRL-37 (cercopithecidae, primate cathelicidin) | RLGNFFRKAKKKIGRGLKKIGQKI KDFLGNLVPRTES | 2587 |
| AP00736 | Ref, cjaRL-37 (primate cathelicidin) | RLGDILQKAREKIEGGLKKLVQKI KDFFGKFAPRTES | 2588 |
| AP00737 | Ref, Plasticin PBN2KF (XXA, DRP-PBN2, frog) | GLVTSLIKGAGKLLGGLFGSVTG | 2589 |
| AP00738 | Ref, Plasticin ANCKF (XXA, synthetic) | GLVTGLLKTAGKLLGDLFGSLTG | 2590 |
| AP00739 | Ref, Plasticin PD36KF (XXA, synthetic) | GVVTDLLKTAGKLLGNLFGSLSG | 2591 |
| AP00740 | Ref, Plasticin PD36K (XXA, synthetic) | GVVTDLLKTAGKLLGNLVGSLSG | 2592 |
| AP00741 | Ref, Chicken cathelicidin-B1 (bird cathelicidin) | PITYLDAILAAVRLLNQRISGPCILR LREAQPRPGWVGTLQRRREVSFLV EDGPCPPGVDCRSCEPGALQHCVG TVSIEQQPTAELRCRPLRPQ | 2593 |
| AP00742 | Ref, Chicken gallinacin 4 (Gal 4) | MRILYLLLSVLFVVLQGVAGQPYF SSPIHACRYQRGVCIPGPCRWPYY RVGSCGSGLKSCCVRNRWA | 2594 |
| AP00743 | Ref, Chicken gallinacin 7 (Gal 7) | MKILCFFIVLFVAVHGAVGFSRSPR YHMQCGYRGTFCTPGKCPYGNAY LGLCRPKYSCCRWL | 2595 |
| AP00744 | Ref, Chicken gallinacin 9 (Gal 9) | MQILPLLFAVLLLMLRAEPGLSLA RGLPQDCERRGGFCSHKSCPPGIGR IGLCSKEDFCCRSRWYS | 2596 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00745 | Ref, Chicken LEAP-2 (cLEAP-2) | MTPFWRGVSLRPVGASCRDNSECI TMLCRKNRCFLRTASE | 2597 |
| AP00814 | Ref, Caerulein precursor-related fragment Ea (CPRF-Ea, frog) | GLGSILGKILNVAGKVGKTIGKVA DAVGNKE | 2598 |
| AP00815 | Ref, Caerulein precursor-related fragment Eb (CPRF-Eb, frog) | GLGSFLKNAIKIAGKVGSTIGKVAD AIGNKE | 2599 |
| AP00816 | Ref, Caerulein precursor-related fragment Ec (CPRF-Ec, frog) | GLGSFFKNAIKIAGKVGSTIGKVAD AIGNKE | 2600 |
| AP00817 | Ref, Temporin-1Oa (frog) | FLPLLASLFSRLL | 2601 |
| AP00818 | Ref, Temporin-1Ob (frog) | FLPLIGKILGTIL | 2602 |
| AP00819 | Ref, Temporin-1Oc (frog) | FLPLLASLFSRLF | 2603 |
| AP00820 | Ref, Temporin-1Od (frog) | FLPLLASLFSGLF | 2604 |
| AP00821 | Ref, Brevinin-2Oa (frog) | GLFNVFKGLKTAGKHVAGSLLNQ LKCKVSGGC | 2605 |
| AP00822 | Ref, Brevinin-2Ob (frog) | GIFNVFKGALKTAGKHVAGSLLNQ LKCKVSGEC | 2606 |
| AP00824 | Ref, Temporin-1Gb (XXA, frog) | SILPTIVSFLSKFL | 2607 |
| AP00825 | Ref, Temporin-1Gc (XXA, frog) | SILPTIVSFLTKFL | 2608 |
| AP00826 | Ref, Temporin-1Gd (XXA, frog) | FILPLIASFLSKFL | 2609 |
| AP00827 | Ref, Ranatuerin-1Ga (frog) | SMISVLKNLGKVGLGFVACKVNK QC | 2610 |
| AP00829 | Ref, Ranalexin-1G (frog) | FLGGLMKIIPAAFCAVTKKC | 2611 |
| AP00830 | Ref, Ranatuerin-2G (frog) | GLLLDTLKGAAKDIAGIALEKLKC KITGCKP | 2612 |
| AP00831 | Ref, Odorranain-NR (frog) | GLLSGILGAGKHIVCGLTGCAKA | 2613 |
| AP00832 | Ref, Maximin H1 (XXA, toad) | ILGPVISTIGGVLGGLLKNL | 2614 |
| AP00834 | Ref, *G. mellonella* moricin-like peptide A (Gm-mlpA, insect) | KVNANAIKKGGKAIGKGFKVISAA STAHDVYEHIKNRRH | 2615 |
| AP00835 | Ref, *G. mellonella* moricin-like peptide B (Gm-mlpB, insect) | GKIPVKAIKKGGQIIGKALRGINIAS TAHDIISQFKPKKKKNH | 2616 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00836 | Ref, *G. mellonella* moricin-like peptide C1 (Gm-mlpC1, insect) | KVPIGAIKKGGKIIKKGLGVIGAAG TAHEVYSHVKNRH | 2617 |
| AP00837 | Ref, *G. mellonella* moricin-like peptide C2 (Gm-mlpC2, insect) | KVPIGAIKKGGKIIKKGLGVLGAA GTAHEVYNHVRNRQ | 2618 |
| AP00838 | Ref, *G. mellonella* moricin-like peptide C3 (Gm-mlpC3, insect) | KVPIGAIKKGGKIIKKGLGVIGAAG TAHEVYSHVKNRQ | 2619 |
| AP00839 | Ref, *G. mellonella* moricin-like peptide C4/C5 (Gm-mlpC4/C5, insect) | KVPVGAIKKGGKAIKTGLGVVGA AGTAHEVYSHIRNRH | 2620 |
| AP00840 | Ref, *G. mellonella* moricin-like peptide D (Gm-mlpD, insect) | KGIGSALKKGGKIIKGGLGALGAIG TGQQVYEHVQNRQ | 2621 |
| AP00841 | Ref, Enterocin A (EntA, class IIA bacteriocin, i.e. pediocin-like peptide, bacteria) | TTHSGKYYGNGVYCTKNKCTVD WAKATTCIAGMSIGGFLGGAIPGKC | 2622 |
| AP00842 | Ref, Divercin V41 (DvnV41, class IIa bacteriocin, pediocin-like peptide, bacteria. DvnRV41 is the recombinant form) | TKYYGNGVYCNSKKCWVDWGQA SGCIGQTVVGGWLGGAIPGKC | 2623 |
| AP00843 | Ref, Divergicin M35 (class IIa bacteriocin, pediocin-like peptide, bacteria) | TKYYGNGVYCNSKKCWVDWGTA QGCIDVVIGQLGGGIPGKGKC | 2624 |
| AP00844 | Ref, Coagulin (bacteriocin, pediocin-like peptide, bacteria) | KYYGNGVTCGKHSCSVDWGKATT CIINNGAMAWATGGHQGTHKC | 2625 |
| AP00845 | Ref, Listeriocin 743A (class IIa bacteriocin, pediocin-like peptide, bacteria) | KSYGNGVHCNKKKCWVDWGSAIS TIGNNSAANWATGGAAGWKS | 2626 |
| AP00846 | Ref, Mundticin KS (enterocin CRL35, mundticin AT06, mundticin QU2, class IIa bacteriocin, pediocin-like peptide, bacteria) | KYYGNGVSCNKKGCSVDWGKAIG IIGNNSAANLATGGAAGWKS | 2627 |
| AP00847 | Ref, Sakacin 5X (Sak5X, class IIa bacteriocin, pediocin-like peptide, bacteria) | KYYGNGLSCNKSGCSVDWSKAISII GNNAVANLTTGGAAGWKS | 2628 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00848 | Ref, Leucocin C (class IIa bacteriocin, pediocin-like peptide, bacteria) | KNYGNGVHCTKKGCSVDWGYAW ANIANNSVMNGLTGGNAGWHN | 2629 |
| AP00849 | Ref, Lactococcin MMFII (class IIa bacteriocin, pediocin-like peptide, bacteria) | TSYGNGVHCNKSKCWIDVSELETY KAGTVSNPKDILW | 2630 |
| AP00850 | Ref, Sakacin G (SakG, class IIa bacteriocin, pediocin-like peptide, bacteria) | KYYGNGVSCNSHGCSVNWGQAW TCGVNHLANGGHGVC | 2631 |
| AP00851 | Ref, Plantaricin 423 (class IIa bacteriocin, pediocin-like peptide, bacteria) | KYYGNGVTCGKHSCSVNWGQAFS CSVSHLANFGHGKC | 2632 |
| AP00852 | Ref, Plantaricin C19 (class IIa bacteriocin, pediocin-like peptide, bacteria) | KYYGNGLSCSKKGCTVNWGQAFS CGVNRVATAGHHKC | 2633 |
| AP00853 | Ref, Enterocin P (EntP, class IIa bacteriocin, pediocin-like peptide, bacteria) | ATRSYGNGVYCNNSKCWVNWGE AKENIAGIVISGWASGLAGMGH | 2634 |
| AP00854 | Ref, Bacteriocin 31 (Bac 31, Bac31, class IIa bacteriocin, pediocin-like peptide, bacteria) | ATYYGNGLYCNKQKCWVDWNKA SREIGKIIVNGWVQHGPWAPR | 2635 |
| AP00855 | Ref, MSI-78 (XXA, synthetic) | GIGKFLKKAKKFGKAFVKILKK | 2636 |
| AP00856 | Ref, MSI-594 (XXA, synthetic) | GIGKFLKKAKKGIGAVLKVLTTGL | 2637 |
| AP00857 | Ref, Catestatin (human CHGA(352-372), human Cst) | SSMKLSFRARAYGFRGPGPQL | 2638 |
| AP00858 | Ref, Temporin D (XXA, frog) | LLPIVGNLLNSLL | 2639 |
| AP00859 | Ref, Temporin H (XXA, frog) | LSPNLLKSLL | 2640 |
| AP00861 | Ref, Brevinin-ALb (frog) | FLPLAVSLAANFLPKLFCKITKKC | 2641 |
| AP00862 | Ref, Brevinin 1E (frog) | FLPLLAGLAANFLPKIFCKITKRC | 2642 |
| AP00863 | Ref, Temporin-ALa (XXA, frog) | FLPIVGKLLSGLSGLL | 2643 |
| AP00864 | Ref, Temporin 1ARa (XXA, frog) | FLPIVGRLISGLL | 2644 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00865 | Ref, Temporin 1AUa (XXA, Temporin-1AUa) (frog) | FLPIIGQLLSGLL | 2645 |
| AP00866 | Ref, Temporin 1Bya (XXA, Temporin-1Bya, frog) | FLPIIAKVLSGLL | 2646 |
| AP00867 | Ref, Temporin 1Ec (XXA, frog) | FLPVIAGLLSKLF | 2647 |
| AP00869 | Ref, Temporin 1Ja (XXA, Temporin-1Ja, frog) | ILPLVGNLLNDLL | 2648 |
| AP00873 | Ref, Temporin 1Pra (XXA, frog) | ILPILGNLLNGLL | 2649 |
| AP00874 | Ref, Temporin 1VE (XXA, frog) | FLPLVGKILSGLI | 2650 |
| AP00875 | Ref, Temporin 1Va (XXA, frog) | FLSSIGKILGNLL | 2651 |
| AP00876 | Ref, Temporin 1Vb (XXA, frog) | FLSIIAKVLGSLF | 2652 |
| AP00877 | Ref, Brevinin-1Ja (frog) | FLGSLIGAAIPAIKQLLGLKK | 2653 |
| AP00878 | Ref, Brevinin-1BYa (frog) | FLPILASLAAKFGPKLFCLVTKKC | 2654 |
| AP00884 | Ref, Ixosin-B (tick) | QLKVDLWGTRSGIQPEQHSSGKSD VRRWRSRY | 2655 |
| AP00885 | Ref, Brevinin-1BYb (frog) | FLPILASLAAKLGPKLFCLVTKKC | 2656 |
| AP00886 | Ref, Brevinin-1BYc (frog) | FLPILASLAATLGPKLLCLITKKC | 2657 |
| AP00887 | Ref, Brevinin-2BYa (frog) | GILSTFKGLAKGVAKDLAGNLLDK FKCKITGC | 2658 |
| AP00888 | Ref, Brevinin-2BYb (frog) | GIMDSVKGLAKNLAGKLLDSLKC KITGC | 2659 |
| AP00891 | Ref, Pilosulin 3 (Myr b III) (ants) | IIGLVSKGTCVLVKTVCKKVLKQG | 2660 |
| AP00892 | Ref, Pilosulin 4 (Myr b IV) (ants) | PDITKLNIKKLTKATCKVISKGASM CKVLFDKKKQE | 2661 |
| AP00893 | Ref, Pilosulin 5 (Myr b III) (ants) | DVKGMKKAIKGILDCVIEKGYDKL AAKLKKVIQQLWE | 2662 |
| AP00894 | Ref, Ocellatin 4 (XXA, frog) | GLLDFVTGVGKDIFAQLIKQI | 2663 |
| AP00895 | Ref, OH-CATH (snake cathelicidin, reptile cathelicidin, or elapid cathelicidins) | KRFKKFFKKLKNSVKKRAKKFFK KPRVIGVSIPF | 2664 |
| AP00896 | Ref, BF-CATH (snake cathelicidin) | KRFKKFFKKLKKSVKKRAKKFFK KPRVIGVSIPF | 2665 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00897 | Ref, NA-CATH (snake cathelicidin) | KRFKKFFKKLKNSVKKRAKKFFK KPKVIGVTFPF | 2666 |
| AP00898 | Ref, Temporin-1Sa (XXA, frog) | FLSGIVGMLGKLF | 2667 |
| AP00899 | Ref, Temporin-1Sb (XXA, frog) | FLPIVTNLLSGLL | 2668 |
| AP00900 | Ref, Temporin-1Sc (XXA, frog) | FLSHIAGFLSNLF | 2669 |
| AP00913 | Ref, Ib-AMP1 (IbAMP1, plant defensin) | EWGRRCCGWGPGRRYCVRWC | 2670 |
| AP00914 | Ref, Ib-AMP2 (IBAMP2, plant defensin) | QYGRRCCNWGPGRRYCKRWC | 2671 |
| AP00915 | Ref, Ee-CBP (EeCBP, plant defensin, hevein-type, *E. europaeus* chitin-binding protein) | QQCGRQAGNRRCANNLCCSQYGY CGRTNEYCCTSQGCQSQCRRCG | 2672 |
| AP00916 | Ref, Pa-AMP1 (PaAMP1, plant defensin, C6 type) | AGCIKNGGRCNASAGPPYCCSSYC FQIAGQSYGVCKNR | 2673 |
| AP00917 | Ref, Pa-AMP2 (PaAMP2, plant defensin, C6 type) | ACIKNGGRCVASGGPPYCCSNYCL QIAGQSYGVCKKH | 2674 |
| AP00924 | Ref, *Ornithodoros* defensin B (soft ticks) | GYGCPFNQYQCHSHCRGIRGYKG GYCTGRFKQTCKCY | 2675 |
| AP00925 | Ref, *Ornithodoros* defensin C (soft ticks) | GYGCPFNQYQCHSHCSGIRGYKGG YCKGLFKQTCNCY | 2676 |
| AP00926 | Ref, *Ornithodoros* defensin D (soft ticks) | GFGCPFNQYECHAHCSGVPGYKG GYCKGLFKQTCNCY | 2677 |
| AP00927 | Ref, Butyrivibriocin AR10 (XXC, class IV bacteriocin, gram-positive bacteria) | IYFIADKMGIQLAPAWYQDIVNWV SAGGTLTTGFAIIVGVTVPAWIAEA AAAFGIASA | 2678 |
| AP00929 | Ref, AS-48 (enterocin 4, XXC, class IV bacteriocin or class IId bacteriocin, Gram-positive bacteria) | ASLQFLPIAHMAKEFGIPAAVAGT VINVVEAGGWVTTIVSILTAVGSG GLSLLAAAGRESIKAYLKKEIKKK GKRAVIAW | 2679 |
| AP00930 | Ref, Reutericin 6 (XXC, XXD1, class IV bacteriocin, Gram-positive bacteria) | IYWIADQFGIHLATGTARKLLDAM ASGASLGTAFAAILGVTLPAWALA AAGALGATAA | 2680 |
| AP00931 | Ref, Uberolysin (XXC, class IV bacteriocin, Gram-positive bacteria) | LAGYTGIASGTAKKVVDAIDKGAA AFVIISIISTVISAGALGAVSASADFI ILTVKNYISRNLKAQAVIW | 2681 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP00932 | Ref, Acidocin B (XXC, class IV bacteriocin, Gram-positive bacteria) | IYWIADQFGIHLATGTARKLLDAV ASGASLGTAFAAILGVTLPAWALA AAGALGATAA | 2682 |
| AP00980 | Ref, Phormia defensin B (insect defensin B) | ATCDLLSGTGINHSACAAHCLLRG NRGGYCNRKGVCVCRN | 2683 |
| AP00990 | Ref, Pth-St1 (plant defensin) | RNCESLSHRFKGPCTRDSN | 2684 |
| AP00991 | Ref, Snakin-1 (StSN1, plant defensin) | GSNFCDSKCKLRCSKAGLADRCLK YCGICCEECKCVPSGTYGNKHECP CYRDKKNSKGKSKCP | 2685 |
| AP00992 | Ref, Snakin-2 (StSN, plant defensin) | YSYKKIDCGGACAARCRLSSRPRL CNRACGTCCARCNCVPPGTSGNTE TCPCYASLTTHGNKRKCP | 2686 |
| AP00993 | Ref, So-D2 (S. oleracea defensin D2, plant defensin) | GIFSSRKCKTPSKTFKGICTRDSNC DTSCRYEGYPAGDCKGIRRRCMCS KPC | 2687 |
| AP00994 | Ref, So-D6 (S. oleracea defensin D6, plant defensin) | GIFSNMYARTPAGYFRGP | 2688 |
| AP00997 | Ref, Nisin Q (lantibiotic, bacteriocins, bacteria) | ITSISLCTPGCKTGVLMGCNLKTAT CNCSVHVSK | 2689 |
| AP01008 | Ref, Tachystatin A1 (BBS, horseshoe crabs) | YSRCQLQGFNCVVRSYGLPTIPCC RGLTCRSYFPGSTYGRCQRF | 2690 |
| AP01009 | Ref, Tachystatin C (BBS, horseshoe crabs) | DYDWSLRGPPKCATYGQKCRTWS PRNCCWNLRCKAFRCRPR | 2691 |
| AP01012 | Ref, Latarcin 3a (Ltc3a, XXA, BBM, spider) | SWKSMAKKLKEYMEKLKQRA | 2692 |
| AP01013 | Ref, Latarcin 3b (Ltc3b, XXA, BBM, spider) | SWASMAKKLKEYMEKLKQRA | 2693 |
| AP01014 | Ref, Latarcin 4a (Ltc4a, XXA, BBM, spider) | GLKDKFKSMGEKLKQYIQTWKAKF | 2694 |
| AP01015 | Ref, Latarcin 4b (Ltc4b, XXA, BBM, spider) | SLKDKVKSMGEKLKQYIQTWKAKF | 2695 |
| AP01016 | Ref, Latarcin 5 (Ltc5, XXA, BBM, spider) | GFFGKMKEYFKKFGASFKRRFANL KKRL | 2696 |
| AP01018 | Ref, Latarcin 6a (Ltc6a, BBM, spider) | QAFQTFKPDWNKIRYDAMKQTS LGQMKKRFNL | 2697 |
| AP01019 | Ref, Latarcin 7 (Ltc7, BBM, spider) | GETFDKLKEKLKTFYQKLVEKAED LKGDLKAKLS | 2698 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP01049 | Ref, Kalata B2 (plant cyclotides, XXC) | VCGETCFGGTCNTPGCSCTWPICT RDGLP | 2699 |
| AP01141 | Ref, Cryptdin-6 (Crp6, animal defensin, alpha, mouse) | LRDLVCYCRARGCKGRERMNGTC RKGHLLYMLCCR | 2700 |
| AP01142 | Ref, Rabbit kidney defensin RK-2 (animal defensin, alpha-defensin) | KPYCSCKWRCGIGEEEKGICHKFPI VTYVCCRRP | 2701 |
| AP01146 | Ref, Gallinacin 6 (Gal6, Gal-6, avian beta defensin, bird) | DTLACRQSHGSCSFVACRAPSVDI GTCRGGKLKCCKWAPSS | 2702 |
| AP01147 | Ref, Gallinacin 8 (Gal8, Gal-8, avian beta defensin, bird) | DTVACRIQGNFCRAGACPPTFTISG QCHGGLLNCCAKIPAQ | 2703 |
| AP01148 | Ref, Gallinacin 3 (Gal3, Gal-3, avian beta defensin, bird) | IATQCRIRGGFCRVGSCRFPHIAIGK CATFISCCGRAY | 2704 |
| AP01152 | Ref, Lactococcin Q (class IIb bacteriocin, bacteria, chain a. For chain b, see Info) | SIWGDIGQGVGKAAYWVGKAMG NMSDVNQASRINRKKKH | 2705 |
| AP01155 | Ref, Enterocin 1071 (Ent1071A, class IIb bacteriocin, bacteria; chain B is Enterocin 1071B or Ent1071B, see info) | ESVFSKIGNAVGPAAYWILKGLGN MSDVNQADRINRKKH | 2706 |
| AP01156 | Ref, Plantaricin S (chain a, class IIb bacteriocin, bacteria) | NKLAYNMGHYAGKATIFGLAAW ALLA | 2707 |
| AP01159 | Ref, Hinnavin II (Hin II, XXA, insect) | KWKIFKKIEHMGQNIRDGLIKAGP AVQVVGQAATIYK | 2708 |
| AP01160 | Ref, NK-2 (synthetic, XXA) | KILRGLCKKIMRSFLRRISWDILTG KK | 2709 |
| AP01167 | Ref, Plantaricin NC8 (PLNC8, chain a, class IIb bacteriocin, bacteria. For chain b, see Info) | LTTKLWSSWGYYLGKKARWNLK HPYVQF | 2710 |
| AP01168 | Ref, Carnocyclin A (a circular bacteriocin, XXC, bacteria) | LVAYGIAQGTAEKVVSLINAGLTV GSIISILGGVTVGLSGVFTAVKAAI AKQGIKKAIQL | 2711 |
| AP01169 | Ref, Lactacin F (LafX, class IIb bacteriocin, bacteria. For LafA, see Info) | NRWGDTVLSAASGAGTGIKACKSF GPWGMAICGVGGAAIGGYFGYTHN | 2712 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP01170 | Ref, Brochocin C (BrcC, chain BrcA, class IIb bacteriocin, bacteria. For BrcB, see Info) | YSSKDCLKDIGKGIGAGTVAGAAG GGLAAGLGAIPGAFVGAHFGVIGG SAACIGGLLGN | 2713 |
| AP01171 | Ref, Thermophilin 13 (chain a ThmA, 2-chain class IIb bacteriocin, bacteria. For chain B ThmB, see Info) | YSGKDCLKDMGGYALAGAGSGAL WGAPAGGVGALPGAFVGAHVGAI AGGFACMGGMIGNKFN | 2714 |
| AP01172 | Ref, ABP-118 (chain a: Abp118alpha, class IIb bacteriocin, bacteria. For chain b: Abp118beta, see Info) | KRGPNCVGNFLGGLFAGAAAGVP LGPAGIVGGANLGMVGGALTCL | 2715 |
| AP01173 | Ref, Salivaricin P (chain a: Sln1; class IIb bacteriocin, bacteria. For chain b: Sln2, see Info) | KRGPNCVGNFLGGLFAGAAAGVP LGPAGIVGGANLGMVGGALTCL | 2716 |
| AP01174 | Ref, Mutacin IV (chain a: NlmA, class IIb bacteriocin, bacteria. For chain b: NLmB, see Info) | KVSGGEAVAAIGICATASAAIGGL AGATLVTPYCVGTWGLIRSH | 2717 |
| AP01175 | Ref, Lactocin 705 (chain a: Lac705alpha; class IIb bacteriocin, bacteria. For chain b: Lac705beta, see Info) | GMSGYIQGIPDFLKGYLHGISAAN KHKKGRLGY | 2718 |
| AP01176 | Ref, Cytolysin (CylLS, bacteria; Chain B: CylLL) | TTPACFTIGLGVGALFSAKFC | 2719 |
| AP01177 | Ref, Plantaricin EF (chain a. PlnE, class IIb bacteriocin, bacteria. Chain b: PlnF) | FNRGGYNFGKSVRHVVDAIGSVA GILKSIR | 2720 |
| AP01178 | Ref, Plantaricin JK (chain a: PlnJ; class IIb bacteriocin, bacteria. Chain b: PlnK) | GAWKNFWSSLRKGFYDGEAGRAI RR | 2721 |
| AP01179 | Ref, Enterocin SE-K4 (class IIa bacteriocin, bacteria) | NGVYCNKQKCWVDWSRARSEIID RGVKAYVNGFTKVLGGIGGR | 2722 |
| AP01180 | Ref, Acidocin J1132 (class IIb bacteriocin, bacteria) | NPKVAHCASQIGRSTAWGAVSGA | 2723 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP01181 | Ref, Curvaticin L442 (class IIa bacteriocin, bacteria) | AYPGNGVHCGKYSCTVDKQTAIG NIGNNAA | 2724 |
| AP01182 | Ref, Bacteriocin 32 (Bac 32, class IIa bacteriocin, bacteria) | FTPSVSFSQNGGVVEAAAQRGYIY KKYPKGAKVPNKVKMLVNIRGKQ TMRTCYLMSWTASSRTAKYYYYI | 2725 |
| AP01183 | Ref, Bacteriocin 43 (Bac 43, bacteriocin, bacteria) | ATYYGNGLYCNKEKCWVDWNQA KGEIGKIIVNGWVNHGPWAPRR | 2726 |
| AP01184 | Ref, Bacteriocin T8 (Bac T8, class IIa bacteriocin, bacteria) | ATYYGNGLYCNKEKCWVDWNQA KGEIGKIIVNGWVNHGPWAPRR | 2727 |
| AP01185 | Ref, Enterocin B (EntB, bacteriocin, bacteria) | ENDHRMPNNLNRPNNLSKGGAKC GAAIAGGLFGIPKGPLAWAAGLAN VYSKCN | 2728 |
| AP01186 | Ref, Acidocin A (bacteriocin, bacteria) | KTYYGTNGVHCTKKSLWGKVRLK NVIPGTLCRKQSLPIKQDLKILLGW ATGAFGKTFH | 2729 |
| AP01187 | Ref, Enterocin Q (EntQ, class IIc bacteriocin, leaderless, i.e. no signal peptide, bacteria) | MNFLKNGIAKWMTGAELQAYKK KYGCLPWEKISC | 2730 |
| AP01188 | Ref, Enterocin EJ97 (EntEJ97, class IIc bacteriocin, leaderless, i.e. no signal peptide, bacteria) | MLAKIKAMIKKFPNPYTLAAKLTT YEINWYKQQYGRYPWERPVA | 2731 |
| AP01189 | Ref, Enterocin RJ-11 (EntRJ-11, class IIc bacteriocin, leaderless, i.e. no signal sequence, bacteria) | APAGLVAKFGRPIVKKYYKQIMQF IGEGSAINKIIPWIARMWRT | 2732 |
| AP01190 | Ref, Enterocin L50 (old name: pediocin L50, EntL50A, a two-chain class IIc bacteriocin, leaderless, i.e. no signal peptide, bacteria. The sequence of EntL50B is provided in Info) | MGAIAKLVAKFGWPIVKKYYKQI MQFIGEGWAINKIIEWIKKHI | 2733 |
| AP01191 | Ref, MR10 (MR10A, class IIc bacteriocin, leaderless, i.e. no signal peptide, bacteria. For the sequence of chain b, see Info) | MGAIAKLVAKFGWPIVKKYYKQI MQFIGEGWAINKIIDWIKKHI | 2734 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| AP01192 | Ref, Halocin S8 (HalS8, microhalocin, archaeocins, archeae) | SDCNINSNTAADVILCFNQVGSCA LCSPTLVGGPVP | 2735 |
| AP01193 | Ref, Halocin C8 (HalC8, microhalocins, archaeocins, archaea) | DIDITGCSACKYAAGQVCTIGCSA AGGFICGLLGITIPVAGLSCLGFVEI VCTVADEYSGCGDAVAKEACNRA GLC | 2736 |
| AP01194 | Ref, Lacticin 3147 (chain A1, a two-chain lantibiotic, bacteriocin, bacteria. The sequence of chain A2 is given in Info; XXD3) | CSTNTFSLSDYWGNNGAWCTLTH ECMAWCK | 2737 |
| AP01195 | Ref, Salivaricin A (SalA, lantibiotic, bacteriocin, bacteria) | KRGSGWIATITDDCPNSVFVCC | 2738 |
| AP01196 | Ref, Microcin E492 (MccE492, class IIb microcins, bacteriocin, bacteria; BBM; u-MccE492, siderophore peptide, BBI, XXG) | ATYYGNGLYCNKEKCWVDWNQA KGEIGKIIVNGWVNHGPWAPRR | 2739 |
| AP01197 | Ref, Hiracin JM79 (HirJM79, a Sec-dependent class II bacteriocin, bacteria) | ATYYGNGLYCNKEKCWVDWNQA KGEIGKIIVNGWVNHGPWAPRR | 2740 |
| AP01198 | Ref, Thermophilin 9 (BlpDst, class IIb bacteriocin, bacteria. beta-chains: BlpUst, BlpEst, BapFst) | LSCDEGMLAVGGLGAVGGPWGA AVGVLVGAALYCF | 2741 |
| AP01199 | Ref, Penocin A (PenA, class IIa bacteriocin, bacteria) | KYYGNGVHCGKKTCYVDWGQAT ASIGKIIVNGWTQHGPWAHR | 2742 |
| AP01200 | Ref, Salivaricin B (SalB, lantibotic, bacteriocin, bacteria) | GGGVIQTISHECRMNSWQFLFTCCS | 2743 |
| AP01201 | Ref, Lacticin 481 (lantibiotic, class I bacteriocin, bacteria) | KGGSGVIHTISHECNMNSWQFVFT CCS | 2744 |
| AP01202 | Ref, Bacteriocin J46 (BacJ46, bacteriocin, bacteria) | KGGSGVIHTISHEVIYNSWNFVFTC CS | 2745 |
| AP01203 | Ref, Nukacin A (NucA, Nukacin ISK-1, NukISK-1, | KKKSGVIPTVSHDCHMNSFQFVFT CCS | 2746 |

TABLE 14-continued

Other illustrative antimicrobial peptides. AP numbers refer to ID in antimicrobial peptide database (http://aps.unmc.edu/AP/main.php).

| | Effector | Structure/Sequence | SEQ ID No |
|---|---|---|---|
| | bacteriocin, bacteria) | | |
| AP01204 | Ref, Streptococcin A-FF22 (LANTIBIOTIC, class I bacteriocin, bacteria) | GKNGVFKTISHECHLNTWAFLATC CS | 2747 |
| AP01210 | Ref, Jelleine-I (honeybees, insect, XXA) | PFKLSLHL | 2748 |
| AP01211 | Ref, Jelleine-II (honeybees, insect, XXA) | TPFKLSLHL | 2749 |
| AP01212 | Ref, Jelleine-III (honeybees, insect, XXA) | EPFKLSLHL | 2750 |
| AP01213 | Ref, Hymenoptaecin (honeybees, insect defensin, XXcooh) | EFRGSIVIQGTKEGKSRPSLDIDYK QRVYDKNGMTGDAYGGLNIRPGQ PSRQHAGFEFGKEYKNGFIKGQSE VQRGPGGRLSPYFGINGGFRF | 2751 |
| AP01216 | Ref, Ascaphin-1 (frog, XXA) | GFRDVLKGAAKAFVKTVAGHIAN | 2752 |
| AP01218 | Ref, Ascaphin-3 (frog) | GFRDVLKGAAKAFVKTVAGHIANI | 2753 |
| AP01220 | Ref, Ascaphin-5 (frog) | GIKDWIKGAAKKLIKTVASNIANQ | 2754 |
| AP01222 | Ref, Ascaphin-7 (frog) | GFKDWIKGAAKKLIKTVASSIANQ | 2755 |
| AP01223 | Ref, Ascaphin-8 (frog, XXA) | GFKDLLKGAAKALVKTVLF | 2756 |
| AP01226 | Ref, Microcin C7 (MccC7, microcin C51, MccC51, class I microcins, bacteriocins, bacteria. Others: MccA; XXamp; BBPe) | MRTGNAD | 2757 |
| AP01227 | Ref, Microcin B17 (MccB17, class I microcins, bacteriocins, Gram-negative bacteria; BBPe) | VGIGGGGGGGGGSCGGQGGGCG GCSNGCSGGNGGSGGSGSHI | 2758 |
| AP01228 | Ref, Microcin V (MccV, (old name) Colicin V, ColV; class II microcins, bacteriocins, Gram-negative bacteria) | ASGRDIAMAIGTLSGQFVAGGIGA AAGGVAGGAIYDYASTHKPNPAM SPSGLGGTIKQKPEGIPSEAWNYAA GRLCNWSPNNLSDVCL | 2759 |
| AP01229 | Ref, Microcin L (MccL, class IIa microcins, bacteriocins, Gram-negative bacteria) | GDVNWVDVGKTVATNGAGVIGG AFGAGLCGPVCAGAFAVGSSAAV AALYDAAGNSNSAKQKPEGLPPEA WNYAEGRMCNWSPNNLSDVCL | 2760 |
| AP01230 | Ref, Microcin M (MccM, class IIb | DGNDGQAELIAIGSLAGTFISPGFG SIAGAYIGDKVHSWATTATVSPSM | 2761 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| microcins, bacteriocins, Gram-negative bacteria) | SPSGIGLSSQFGSGRGTSSASSSAGSGS | |
| AP01231 Ref, Microcin H47 (MccH47, class IIb microcins, bacteriocins, Gram-negative bacteria) | GGAPATSANAAGAAAIVGALAGIPGGPLGVVVGAVSAGLTTGIGSTVGSGSASSSAGGGS | 2762 |
| AP01232 Ref, Microcin I47 (MccI47, class IIb microcins, bacteriocins, Gram-negative bacteria) | MNLNGLPASTNVIDLRGKDMGTYIDANGACWAPDTPSIIMYPGGSGPSYSMSSSTSSANSGS | 2763 |
| Aibellin | *Ac U A U A U A Q U F U G U U P V U U E E [NHC(CH2Ph)HCH2NHCH2CH2]OH | 2764 |
| Alamethicin_F-30 | * Ac U P U A U A Q U V U G L U P V U U E Q F OH | 2765 |
| Alamethicin_F-50 | * Ac U P U A U A Q U V U G L U P V U U Q Q F OH | 2766 |
| Alamethicin_II | * Ac U P U A U U Q U V U G L U P V U U E Q F OH | 2767 |
| Ampullosporin | * Ac W A U U L U Q U U U Q L U Q L OH | 2768 |
| Ampullosporin_B | * Ac W A U U L U Q A U U Q L U Q L OH | 2769 |
| Ampullosporin_C | * Ac W A U U L U Q U A U Q L U Q L OH | 2770 |
| Ampullosporin_D | * Ac W A U U L U Q U U A Q L U Q L OH | 2771 |
| Ampullosporin_E1 | * Ac W A U U L U Q A U U Q L A Q L OH | 2772 |
| Ampullosporin_E2 | * Ac W A U U L U Q U A A Q L U Q L OH | 2773 |
| Ampullosporin_E3 | * Ac W A U U L U Q U U A Q L A Q L OH | 2774 |
| Ampullosporin_E4 | * Ac W A U U L U Q A A U Q L U Q L OH | 2775 |
| Antiamoebin_I | * Ac F U U U J G L U U O Q J O U P F OH | 2776 |
| Antiamoebin_II | * Ac F U U U J G L U U O Q J P U P F OH | 2777 |
| Antiamoebin_III | * Ac F U U U U G L U U O Q J O U P F OH | 2778 |
| Antiamoebin_IV | * Ac F U U U J G L U U O Q J O U P F OH | 2779 |
| Antiamoebin_V | * Ac F U U U J A L U U O Q J O U P F OH | 2780 |
| Antiamoebin_VI | * Ac F U U U U G L U U O Q U O U P F OH | 2781 |
| Antiamoebin_VII | * Ac F A U J U G L U U O Q J O U P F OH | 2782 |
| Antiamoebin_VIII | * Ac F U U U J G L U U O Q U O U P F OH | 2783 |
| Antiamoebin_IX | * Ac F U A U J G L U U O Q J O U P F OH | 2784 |
| Antiamoebin_X | * Ac F U U U J G L J U O Q U O U P F OH | 2785 |
| Antiamoebin_XI | * Ac F U U U U A L U U O Q J O U P F OH | 2786 |
| Antiamoebin_XII | * Ac F U U U U G L A U O Q J O U P F OH | 2787 |
| Antiamoebin_XIII | * Ac V U U U U G L U U O Q J O U P F OH | 2788 |
| Antiamoebin_XIV | * Ac V U U U V G L U U O Q J O U P F OH | 2789 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Antiamoebin_XV | * Ac L U U U U G L U U O Q J O U P F OH | 2790 |
| Antiamoebin_XVI | * Ac L U U U J G L U U O Q J O U P F OH | 2791 |
| Atroviridin_A | * Ac U P U A U A Q U V U G L U P V U U Q Q F OH | 2792 |
| Atroviridin_B | * Ac U P U A U A Q U V U G L U P V U J Q Q F OH | 2793 |
| Atroviridin_C | * Ac U P U A U U Q U V U G L U P V U J Q Q F OH | 2794 |
| Bergofungin_A | * Ac V U U U V G L U U O Q J O U F OH | 2795 |
| Bergofungin_B | * Ac V U U U V G L V U O Q U O U F OH | 2796 |
| Bergofungin_C | * Ac V U U U V G L U U O Q U O U F OH | 2797 |
| Bergofungin_D | * Ac V U U V G L U U O Q U O U F OH | 2798 |
| Boletusin | * Ac F U A U J L Q G U U A A U P U U U Q W OH | 2799 |
| Cephaibol_A | * Ac F U U U U G L J U O Q J O U P F OH | 2800 |
| Cephaibol_A2 | * Ac F U U U U A L J U O Q J O U P F OH | 2801 |
| Cephaibol_B | * Ac F U U U J G L J U O Q J O U P F OH | 2802 |
| Cephaibol_C | * Ac F U U U U G L J U O Q U O U P F OH | 2803 |
| Cephaibol_D | * Ac F U U U U G L U U O Q U O U P F OH | 2804 |
| Cephaibol_E | * Ac F U U U U G L U U O Q J O U P F OH | 2805 |
| Cephaibol_P | * Ac F J Q U I T U L U O Q U O U P F S OH | 2806 |
| Cephaibol_Q | * Ac F J Q U I T U L U P Q U O U P F S OH | 2807 |
| Cervinin_1 | * Ac L U P U L U P A U P V L OH | 2808 |
| Cervinin_2 | * Ac L U P U L U P A U P V L OCOCH3 | 2809 |
| Chrysospermin_A | * Ac F U S U U L Q G U U A A U P U U U Q W OH | 2810 |
| Chrysospermin_B | * Ac F U S U U L Q G U U A A U P J U U Q W OH | 2811 |
| Chrysospermin_C | * Ac F U S U J L Q G U U A A U P U U U Q W OH | 2812 |
| Chrysospermin_D | * Ac F U S U J L Q G U U A A U P J U U Q W OH | 2813 |
| Clonostachin | * Ac U O L J O L J O U J U O J I O[CH(CH(OH)CH2OH)CH(OH)CH(OH)CH2]OH | 2814 |
| Emerimicin_II_A | * Ac W I Q U I T U L U O Q U O U P F OH | 2815 |
| Emerimicin_II_B | * Ac W I Q J I T U L U O Q U O U P F OH | 2816 |
| Emerimicin_III | * Ac F U U U V G L U U O Q J O U F OH | 2817 |
| Emerimicin_IV | * Ac F U U V G L U U O Q J O A F OH | 2818 |
| Harzianin_HB_I | * Ac U N L I U P J L U P L OH | 2819 |
| Harzianin_HC_I | * Ac U N L U P S V U P U L U P L OH | 2820 |
| Harzianin_HC_III | * Ac U N L U P S V U P J L U P L OH | 2821 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Harzianin_HC_IX | * Ac U N L U P A I U P J L U P L OH | 2822 |
| Harzianin_HC_VI | * Ac U N L U P A V U P U L U P L OH | 2823 |
| Harzianin_HC_VIII | * Ac U N L U P A V U P J L U P L OH | 2824 |
| Harzianin_HC_VIII | * Ac U N L U P A V U P J L U P L OH | 2825 |
| Harzianin_HC_X | * Ac U Q L U P A V U P J L U P L OH | 2826 |
| Harzianin_HC_XI | * Ac U N L U P S I U P U L U P L OH | 2827 |
| Harzianin_HC_XII | * Ac U N L U P S I U P J L U P L OH | 2828 |
| Harzianin_HC_XIII | * Ac U Q L U P S I U P J L U P L OH | 2829 |
| Harzianin_HC_XIV | * Ac U N L U P A I U P U L U P L OH | 2830 |
| Harzianin_HC_XV | * Ac U Q L U P A I U P J L U P L OH | 2831 |
| Harzianin_HK_VI | * Ac U N I I U P L L U P L OH | 2832 |
| Harzianin_PCU4 | * Ac U N L U P S I U P U L U P V OH | 2833 |
| Helioferin_A | * Fa P ZZ A U I I U U AAE | 2834 |
| Helioferin_B | * Fa P ZZ A U I I U U AMAE | 2835 |
| Heptaibin | * Ac F U U U V G L U U O Q U O U F OH | 2836 |
| Hypelcin_A | * Ac U P U A U U Q L U G U U P V U U Q Q L OH | 2837 |
| Hypelcin_A_I | * Ac U P U A U U Q U L U G U U P V U U Q Q L OH | 2838 |
| Hypelcin_A_II | * Ac U P U A U A Q U L U G U U P V U U Q Q L OH | 2839 |
| Hypelcin_A_III | * Ac U P U A U U Q U L U G U U P V U U Q Q [C7H16NO] | 2840 |
| Hypelcin_A_IV | * Ac U P U A U U Q U I U G U U P V U U Q Q L OH | 2841 |
| Hypelcin_A-III | * Ac U P U A U U Q U L U G U U P V U J Q Q L OH | 2842 |
| Hypelcin_A-IX | * Ac U P U A U U Q U I U G U U P V U J Q Q L OH | 2843 |
| Hypelcin_A-V | * Ac U P U A U U Q U L U G U U P V U U Q Q I OH | 2844 |
| Hypelcin_A-VI | * Ac U P U A U A Q U L U G U U P V U U Q Q I OH | 2845 |
| Hypelcin_A-VII | * Ac U P U A U A Q U L U G U U P V U J Q Q L OH | 2846 |
| Hypelcin_A-VIII | * Ac U P U A U A Q U I U G U U P V U U Q Q L OH | 2847 |
| Hypelcin_B_I | * Ac U P U A U U Q U L U G U U P V U U E Q L OH | 2848 |
| Hypelcin_B_II | * Ac U P U A U A Q U L U G U U P V U U E Q L OH | 2849 |
| Hypelcin_B_III | * Ac U P U A U U Q U L U G U U P V U J E Q L OH | 2850 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Hypelcin_B_IV | * Ac U P U A U U Q U I G U U P V U U E Q L OH | 2851 |
| Hypelcin_B_V | * Ac U P U A U U Q U L G U U P V U U E Q I OH | 2852 |
| Hypomurocin_A_I | * Ac U Q V V U P L L U P L OH | 2853 |
| Hypomurocin_A_II | * Ac J Q V V U P L L U P L OH | 2854 |
| Hypomurocin_A_III | * Ac U Q V L U P L I U P L OH | 2855 |
| Hypomurocin_A_IV | * Ac U Q I V U P L L U P L OH | 2856 |
| Hypomurocin_A_V | * Ac U Q I I U P L L U P L OH | 2857 |
| Hypomurocin_A_Va | * Ac U Q I L U P L I U P L OH | 2858 |
| Hypomurocin_B_I | * Ac U S A L U Q U V U G U U P L U U Q V OH | 2859 |
| Hypomurocin_B_II | * Ac U S A L U Q U V U G U U P L U U Q L OH | 2860 |
| Hypomurocin_B_IIIa | * Ac U A A L U Q U V U G U U P L U U Q V OH | 2861 |
| Hypomurocin_B_IIIb | * Ac U S A L U Q J V U G U U P L U U Q V OH | 2862 |
| Hypomurocin_B_IV | * Ac U S A L U Q U V U G J U P L U U Q V OH | 2863 |
| Hypomurocin_B_V | * Ac U S A L U Q U V U G J U P L U U Q L OH | 2864 |
| Leu1_Zervamicin | * Ac L I Q J I T U L U O Q U O U P F OH | 2865 |
| Longibrachin_A_I | * Ac U A U A U A Q U V U G L U P V U U Q Q F OH | 2866 |
| Longibrachin_A_II | * Ac U A U A U A Q U V U G L U P V U J Q Q F OH | 2867 |
| Longibrachin_A_III | * Ac U A U A U U Q U V U G L U P V U U Q Q F OH | 2868 |
| Longibrachin_A_IV | * Ac U A U A U U Q U V U G L U P V U J Q Q F OH | 2869 |
| Longibrachin_B_II | * Ac U A U A U A Q U V U G L U P V U U E Q F OH | 2870 |
| Longibrachin_B_III | * Ac U A U A U A Q U V U G L U P V U J E Q F OH | 2871 |
| LP237_F5 | * Oc U P Y U Q Q U Zor Q A L OH | 2872 |
| LP237_F7 | * Ac U P F U Q Q U U Q A L OH | 2873 |
| LP237_F8 | * Oc U P F U Q Q U Zor Q A L OH | 2874 |
| NA_VII | * Ac U A A U J Q U U U S L U OCH3 | 2875 |
| Paracelsin_A | * Ac U A U A U A Q U V U G U U P V U U Q Q F OH | 2876 |
| Paracelsin_B | * Ac U A U A U A Q U L U G U U P V U U Q Q F OH | 2877 |
| Paracelsin_C | * Ac U A U A U U Q U V U G U U P V U U Q Q F OH | 2878 |
| Paracelsin_D | * Ac U A U A U U Q U L U G U U P V U U Q Q F OH | 2879 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Paracelsin_E | * Ac U A U A U A Q U L U G U A P V U U Q Q F OH | 2880 |
| Peptaibolin | * Ac L U L U F OH | 2881 |
| Peptaivirin_A | * Ac F U A U J L Q G U U A A U P J U U Q W OH | 2882 |
| Peptaivirin_B | * Ac F U S U J L Q G U U A A U P J U U Q F OH | 2883 |
| Polysporin_A | * Ac U P U A U U Q U V U G V U P V U U Q Q F OH | 2884 |
| Polysporin_B | * Ac U P U A U U Q U V U G L U P V U U Q Q F OH | 2885 |
| Polysporin_C | * Ac U P U A U U Q U I U G L U P V U U Q Q F OH | 2886 |
| Polysporin_D | * Ac U P U A U U Q U I U G L U P V U U V Q Q F OH | 2887 |
| Pseudokinin_KLIII | * Ac U N I I U P L L U P NH2 | 2888 |
| Pseudokinin_KLVI | * Ac U N I I U P L V hydroxyketopiperazine | 2889 |
| Samarosporin_I | * Ac F U U U V G L U U O Q J O A F OH | 2890 |
| Samarosporin_II | * Ac F U U U V G L U U O Q J O U F OH | 2891 |
| Saturnisporin_SA_I | * Ac U A U A U A Q U L U G U U P V U U Q Q F OH | 2892 |
| Saturnisporin_SA_II | * Ac U A U A U A Q U L U G U U P V U J Q Q F OH | 2893 |
| Saturnisporin_SA_III | * Ac U A U A U U Q U L U G U U P V U U Q Q F OH | 2894 |
| Saturnisporin_SA_IV | * Ac U A U A U U Q U L U G U U P V U J Q Q F OH | 2895 |
| Stilbellin_I | * Ac F U U U V G L U U O Q J O A F OH | 2896 |
| Stilbellin_II | * Ac F U U U V G L U U O Q J O U F OH | 2897 |
| Stilboflavin_A_1 | * Ac U P U A U A Q U V U G U U P V U U E Q V OH | 2898 |
| Stilboflavin_A_2 | * Ac U P U A U A Q U L U G U U P V U U E Q V OH | 2899 |
| Stilboflavin_A_3 | * Ac U P U A U U Q U V U G U A P V U U E Q L OH | 2900 |
| Stilboflavin_A_4 | * Ac U P U A U A Q U L U G U U P V U U E Q L OH | 2901 |
| Stilboflavin_A_5 | * Ac U P U A U U Q U L U G U U P V U U E Q V OH | 2902 |
| Stilboflavin_A_6 | * Ac U P U A U A Q U L U G U U P V U U E Q J OH | 2903 |
| Stilboflavin_A_7 | * Ac U P U A U U Q U L U G U U P V U U E Q I OH | 2904 |
| Stilboflavin_B_1 | * Ac U P U A U A Q U V U G U U P V U U Q Q V OH | 2905 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Stilboflavin_B_2 | * Ac U P U A U A Q U L U G U U P V U U Q Q V OH | 2906 |
| Stilboflavin_B_3 | * Ac U P U A U A Q U V U G U U P V U U Q Q L OH | 2907 |
| Stilboflavin_B_4 | * Ac U P U A U A Q U L U G U U P V U U Q Q L OH | 2908 |
| Stilboflavin_B_5 | * Ac U P U A U U Q U L U G U U P V U U Q Q V OH | 2909 |
| Stilboflavin_B_6 | * Ac U P U A U U Q U V U G U U P V U U Q Q V OH | 2910 |
| Stilboflavin_B_7 | * Ac U P U A U U Q U L U G U U P V U U Q Q L OH | 2911 |
| Stilboflavin_B_8 | * Ac U P U A U U Q U V U G U U P V U U Q Q L OH | 2912 |
| Stilboflavin_B_9 | * Ac U P U A U U Q U L U G U U P V U U Q Q I OH | 2913 |
| Stilboflavin_B_10 | * Ac U P U A U U Q U V U G U U P V U U Q Q I OH | 2914 |
| Suzukacillin | * Ac U A U A U A Q U U U G L U P V U U Q Q F OH | 2915 |
| Trichobrachin_A-I | * Ac U N L L U P L U U P L OH | 2916 |
| Trichobrachin_A-II | * Ac U N L L U P V L U P V OH | 2917 |
| Trichobrachin_A-III | * Ac U N V L U P L L U P V OH | 2918 |
| Trichobrachin_A-IV | * Ac U N L V U P L L U P V OH | 2919 |
| Trichobrachin_B-I | * Ac U N L L U P V U V P L OH | 2920 |
| Trichobrachin_B-II | * Ac U N V L U P L U V P L OH | 2921 |
| Trichobrachin_B-III | * Ac U N L V U P L U V P L OH | 2922 |
| Trichobrachin_B-IV | * Ac U N L L U P L U V P V OH | 2923 |
| Trichocellin_TC-A-I | * Ac U A U A U A Q U L U G U U P V U U Q Q F OH | 2924 |
| Trichocellin_TC-A-II | * Ac U A U A U A Q U L U G U U P V U J Q Q F OH | 2925 |
| Trichocellin_TC-A-III | * Ac U A U A U A Q U I U G U U P V U U Q Q F OH | 2926 |
| Trichocellin_TC-A-IV | * Ac U A U A U A Q U I U G U U P V U J Q Q F OH | 2927 |
| Trichocellin_TC-A-V | * Ac U A U A U A Q U L U G L U P V U U Q Q F OH | 2928 |
| Trichocellin_TC-A-VI | * Ac U A U A U A Q U L U G L U P V U J Q Q F OH | 2929 |
| Trichocellin_TC-A-VII | * Ac U A U A U A Q U I U G L U P V U U Q Q F OH | 2930 |
| Trichocellin_TC-A-VIII | * Ac U A U A U A Q U I U G L U P V U J Q Q F OH | 2931 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Trichocellin_TC-B-I | * Ac U A U A U A Q U L U G U U P V U U E Q F OH | 2932 |
| Trichocellin_TC-B-II | * Ac U A U A U A Q U L U G U U P V U J E Q F OH | 2933 |
| Trichodecenin_TD_I | * (Z)-4-decenoyl G G L U G I L OH | 2934 |
| Trichodecenin_TD_II | * (Z)-4-decenoyl G G L U G L L OH | 2935 |
| Trichogin_A_IV | * Oc U G L U G G L U G I L OH | 2936 |
| Trichokindin_Ia | * Ac U S A U U Q J L U A U U P L U U Q I OH | 2937 |
| Trichokindin_Ib | * Ac U S A U J Q U L U A U U P L U U Q I OH | 2938 |
| Trichokindin_IIa | * Ac U S A U U Q U L U A J U P L U U Q I OH | 2939 |
| Trichokindin_IIb | * Ac U S A U J Q J L U A U U P L U U Q L OH | 2940 |
| Trichokindin_IIIa | * Ac U S A U U Q J L U A J U P L U U Q L OH | 2941 |
| Trichokindin_IIIb | * Ac U S A U J Q U L U A J U P L U U Q L OH | 2942 |
| Trichokindin_IV | * Ac U S A U J Q J L U A U U P L U U Q I OH | 2943 |
| Trichokindin_Va | * Ac U S A U U Q J L U A J U P L U U Q I OH | 2944 |
| Trichokindin_Vb | * Ac U S A U J Q U L U A J U P L U U Q I OH | 2945 |
| Trichokindin_VI | * Ac U S A U J Q J L U A J U P L U U Q L OH | 2946 |
| Trichokindin_VII | * Ac U S A U J Q J L U A J U P L U U Q I OH | 2947 |
| Trichokonin_Ia | * Ac U A U A U A Q U V U G L A P V U U Q Q F OH | 2948 |
| Trichokonin_Ib | * Ac U G U A U A Q U V U G L U P V U U Q Q F OH | 2949 |
| Trichokonin_IIa | * Ac U A U A U A Q U V U G L U P A U U Q Q F OH | 2950 |
| Trichokonin_IIb | * Ac A A U A U A Q U V U G L U P V U U Q Q F OH | 2951 |
| Trichokonin_IIc | * Ac U A A A U A Q U V U G L U P V U U Q Q F OH | 2952 |
| Trichokonin_V | * Ac U A U A U Q U V U G L U P V U U Q Q F OH | 2953 |
| Trichokonin_VII | * Ac U A U A U A Q U V U G L U P V U J Q Q F OH | 2954 |
| Trichokonin_VIII | * Ac U A U A U U Q U V U G L U P V U U Q Q F OH | 2955 |
| Trichokonin_IX | * Ac U A U A U A Q U V U G L U P V U J Q Q F OH | 2956 |
| Tricholongin_BI | * Ac U G F U U Q U U U S L U P V U U Q Q L OH | 2957 |
| Tricholongin_BII | * Ac U G F U U Q U U U S L U P V U J Q Q L OH | 2958 |
| Trichopolyn_I | * Fa P ZZ A U U I A U U AMAE | 2959 |
| Trichopolyn_II | * Fa P ZZ A U U V A U U AMAE | 2960 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Trichopolyn_III | * Fa P ZZ A U U I A U A AMAE | 2961 |
| Trichopolyn_IV | * Fa P ZZ A U U V A U A AMAE | 2962 |
| Trichopolyn_V | * Fa' P ZZ A U U I A U U AMAE | 2963 |
| Trichorovin_TV_Ia | * Ac U N V Lx U P Lx Lx U P V OH | 2964 |
| Trichorovin_TV_Ib | * Ac U N V V U P Lx Lx U P Lx OH | 2965 |
| Trichorovin_TV_IIa | * Ac U N V V U P Lx Lx U P Lx OH | 2966 |
| Trichorovin_TV_IIb | * Ac U N Lx V U P Lx Lx U P V OH | 2967 |
| Trichorovin_TV_IIIa | * Ac U Q V V U P Lx Lx U P Lx OH | 2968 |
| Trichorovin_TV_IIIb | * Ac U Q V Lx U P Lx Lx U P V OH | 2969 |
| Trichorovin_TV_IVa | * Ac U Q V V U P Lx Lx U P Lx OH | 2970 |
| Trichorovin_TV_IVb | * Ac U Q Lx V U P Lx Lx U P V OH | 2971 |
| Trichorovin_TV_IVc | * Ac U N V Lx U P Lx Lx U P Lx OH | 2972 |
| Trichorovin_TV_IXa | * Ac U Q V Lx U P Lx Lx U P Lx OH | 2973 |
| Trichorovin_TV_IXb | * Ac U Q Lx Lx U P Lx Lx U P V OH | 2974 |
| Trichorovin_TV_Va | * Ac U N V Lx U P Lx Lx U P Lx OH | 2975 |
| Trichorovin_TV_Vb | * Ac U N Lx Lx U P Lx Lx U P V OH | 2976 |
| Trichorovin_TV_VIa | * Ac U N V Lx U P Lx Lx U P Lx OH | 2977 |
| Trichorovin_TV_VIb | * Ac U N Lx Lx U P Lx Lx U P V OH | 2978 |
| Trichorovin_TV_VIIa | * Ac U N Lx V U P Lx Lx U P Lx OH | 2979 |
| Trichorovin_TV_VIIb | * Ac U Q V Lx U P Lx Lx U P V OH | 2980 |
| Trichorovin_TV_VIII | * Ac U Q V Lx U P Lx Lx U P Lx OH | 2981 |
| Trichorovin_TV_Xa | * Ac U Q Lx V U P Lx Lx U P Lx OH | 2982 |
| Trichorovin_TV_Xb | * Ac U N Lx Lx U P Lx Lx U P Lx OH | 2983 |
| Trichorovin_TV_XIIa | * Ac U N I I U P L L U P I OH | 2984 |
| Trichorovin_TV_XIIb | * Ac U N Lx Lx U P Lx Lx U P L OH | 2985 |
| Trichorovin_TV_XIII | * Ac U Q Lx Lx U P Lx Lx U P Lx OH | 2986 |
| Trichorovin_TV_XIV | * Ac U Q Lx Lx U P Lx Lx U P Lx OH | 2987 |
| Trichorozin_I | * Ac U N I L U P I L U P V OH | 2988 |
| Trichorozin_II | * Ac U Q I L U P I L U P V OH | 2989 |
| Trichorozin_III | * Ac U N I L U P I L U P L OH | 2990 |
| Trichorozin_IV | * Ac U Q I L U P I L U P L OH | 2991 |
| Trichorzianine_TA_IIIc | * Ac U A A U U Q U U U S L U P V U I Q Q W OH | 2992 |
| Trichorzianine_TB_IIa | * Ac U A A U U Q U U U S L U P L U I Q E W OH | 2993 |
| Trichorzianine_TB_IIIc | * Ac U A A U U Q U U U S L U P V U I Q E W OH | 2994 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Trichorzianine_TB_IVb | * Ac U A A U J Q U U U S L U P V U I Q E W OH | 2995 |
| Trichorzianine_TB_Vb | * Ac U A A U U Q U U U S L U P L U I Q E F OH | 2996 |
| Trichorzianine_TB_VIa | * Ac U A A U J Q U U U S L U P L U I Q E F OH | 2997 |
| Trichorzianine_TB_VIb | * Ac U A A U U Q U U U S L U P V U I Q E F OH | 2998 |
| Trichorzianine_TB_VII | * Ac U A A U J Q U U U S L U P V U I Q E F OH | 2999 |
| Trichorzin_HA_I | * Ac U G A U U Q U V U G L U P L U U Q L OH | 3000 |
| Trichorzin_HA_II | * Ac U G A U U Q U V U G L U P L U J Q L OH | 3001 |
| Trichorzin_HA_III | * Ac U G A U J Q U V U G L U P L U U Q L OH | 3002 |
| Trichorzin_HA_V | * Ac U G A U J Q U V U G L U P L U J Q L OH | 3003 |
| Trichorzin_HA_VI | * Ac U G A U J Q J V U G L U P L U J Q L OH | 3004 |
| Trichorzin_HA_VII | * Ac U G A U J Q V V U G L U P L U J Q L OH | 3005 |
| Trichorzin_MA_I | * Ac U S A U U Q U L U G L U P L U U Q V OH | 3006 |
| Trichorzin_MA_II | * Ac U S A U J Q U L U G L U P L U U Q V OH | 3007 |
| Trichorzin_MA_III | * Ac U S A U J Q J L U G L U P L U U Q V OH | 3008 |
| Trichorzin_PA_II | * Ac U S A U J Q U V U G L U P L U U Q W OH | 3009 |
| Trichorzin_PA_IV | * Ac U S A U J Q J V U G L U P L U U Q W OH | 3010 |
| Trichorzin_PA_V | * Ac U S A J J Q U V U G L U P L U U Q W OH | 3011 |
| Trichorzin_PA_VI | * Ac U S A U J Q U V U G L U P L U U Q F OH | 3012 |
| Trichorzin_PA_VII | * Ac U S A J J Q U V U G L U P L U U Q W OH | 3013 |
| Trichorzin_PA_VIII | * Ac U S A U J Q J V U G L U P L U U Q F OH | 3014 |
| Trichorzin_PA_IX | * Ac U S A J J Q U V U G L U P L U U Q F OH | 3015 |
| Trichorzin_PAU4 | * Ac U S A U U Q U V U G L U P L U U Q W OH | 3016 |
| Trichosporin_TS-B-1a-1 | * Ac U A G U A U Q U Lx A A Vx A P V U Vx Q Q F OH | 3017 |
| Trichosporin_TS-B-1a-2 | * Ac U A G A U U Q U Lx A A Vx A P V U Vx Q Q F OH | 3018 |
| Trichosporin_TS-B-1b | * Ac U A G A U U Q U Lx U G Lx A P V U A Q Q F OH | 3019 |
| Trichosporin_TS-B-1d | * Ac U A S A U U Q U Lx U G Lx A P V U U Q Q F OH | 3020 |
| Trichosporin_TS-B-1e | * Ac U A G A U U Q U Lx U G Lx U P V U U Q Q F OH | 3021 |
| Trichosporin_TS-B-1f | * Ac U A S A U U Q U Lx U G Lx U P V U U Q Q F OH | 3022 |
| Trichosporin_TS-B-1g | * Ac U A G A U U Q U Lx U G Lx A P V U U Q Q F OH | 3023 |
| Trichosporin_TS-B-1h | * Ac U A G A U U Q U Lx U G Lx U P V U Vx Q Q F OH | 3024 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Trichosporin_TS-B-Ia | * Ac U A S A U U Q U L U G L U P V U U Q Q F OH | 3025 |
| Trichosporin_TS-B-IIIa | * Ac U A A A U U Q U L U G L U P V U U Q Q F OH | 3026 |
| Trichosporin_TS-B-IIIb | * Ac U A A A U U Q U I U G L U P V U A Q Q F OH | 3027 |
| Trichosporin_TS-B-IIIc | * Ac U A A A A U Q U I U G L U P V U U Q Q F OH | 3028 |
| Trichosporin_TS-B-IIId | * Ac U A A A U U Q U V U G L U P V U U Q Q F OH | 3029 |
| Trichosporin_TS-B-IVb | * Ac U A A A U U Q U L U G L U P V U J Q Q F OH | 3030 |
| Trichosporin_TS-B-IVc | * Ac U A U A U U Q U V U G L U P V U U Q Q F OH | 3031 |
| Trichosporin_TS-B-IVd | * Ac U A A A U U Q U V U G L U P V U J Q Q F OH | 3032 |
| Trichosporin_TS-B-V | * Ac U A A A U U Q U I U G L U P V U U Q Q F OH | 3033 |
| Trichosporin_TS-B-VIa | * Ac U A U A U U Q U I U G L U P V U U Q Q F OH | 3034 |
| Trichosporin_TS-B-VIb | * Ac U A A A U U Q U I U G L U P V U J Q Q F OH | 3035 |
| Trichotoxin_A-40 | * Ac U G U L U E U U U A U U P L U J Q V OH | 3036 |
| Trichotoxin_A-40_I | * Ac U G U L U Q U U A A U U P L U U E V OH | 3037 |
| Trichotoxin_A-40_II | * Ac U G U L U Q U U U A A U U P L U U E V OH | 3038 |
| Trichotoxin_A-40_III | * Ac U G U L U Q U U A A U U P L U J E V OH | 3039 |
| Trichotoxin_A-40_IV | * Ac U G U L U Q U U U A U U P L U U E V OH | 3040 |
| Trichotoxin_A-40_V | * Ac U G U L U Q U U U A U U P L U J E V OH | 3041 |
| Trichotoxin_A-40_Va | * Ac U A U L U Q U U U A U U P L U U E V OH | 3042 |
| Trichotoxin_A-50_E | * Ac U G U L U Q U U U A A U P L U U Q V OH | 3043 |
| Trichotoxin_A-50_F | * Ac U G U L U Q U U A A A U P L U J Q V OH | 3044 |
| Trichotoxin_A-50_G | * Ac U G U L U Q U U U A A U P L U J Q V OH | 3045 |
| Trichotoxin_A-50_H | * Ac U A U L U Q U U U A A U P L U J Q V OH | 3046 |
| Trichotoxin_A-50_I | * Ac U G U L U Q U U U A U U P L U J Q V OH | 3047 |
| Trichotoxin_A-50_J | * Ac U A U L U Q U U U A U U P L U J Q V OH | 3048 |
| Trichovirin-Ia | * Ac U G A L A Q Vx V U G U U P L U U Q L OH | 3049 |
| Trichovirin-Ib | * Ac U G A L U Q A V U G J U P L U U Q L OH | 3050 |
| Trichovirin-IIa | * Ac U G A L A Q U V U G J U P L U U Q L OH | 3051 |
| Trichovirin-IIb | * Ac U G A L U Q U V U G U U P L U U Q L OH | 3052 |
| Trichovirin-IIc | * Ac U G A L U Q Vx V U G U U P L U U Q L OH | 3053 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| Trichovirin-IIIa | * Ac U G A L U Q J V U G U U P L U U Q L OH | 3054 |
| Trichovirin-IIIb | * Ac U G A L J Q J U U G U U P L U U Q L OH | 3055 |
| Trichovirin-IVa | * Ac U G A L J Q J V U G U U P L U U Q L OH | 3056 |
| Trichovirin-IVb | * Ac U G A L U Q U V U G J U P L U U Q L OH | 3057 |
| Trichovirin-V | * Ac U G A L U Q J V U G J U P L U U Q L OH | 3058 |
| Trichovirin-VIa | * Ac U G A L U Q J L U G J U P L U U Q L OH | 3059 |
| Trichovirin-VIb | * Ac U G A L J Q J V U G J U P L U U Q L OH | 3060 |
| Trikoningin_KA_V | * Ac U G A U I Q U U U S L U P V U I Q Q L OH | 3061 |
| Trikoningin_KB_I | * Oc U G V U G G V U G I L OH | 3062 |
| Trikoningin_KB_II | * Oc J G V U G G V U G I L OH | 3063 |
| Tylopeptin_A | * Ac W V U J A Q A U S U A L U Q L OH | 3064 |
| Tylopeptin_B | * Ac W V U U A Q A U S U A L U Q L OH | 3065 |
| XR586 | * Ac W J Q U I T U L U P Q U O J P F G OH | 3066 |
| Zervamicin_A-1-16 | * Boc W I A U I V U L U P A U P U P F OCH3 | 3067 |
| Zervamicin_ZIA | * Ac W I E J V T U L U O Q U O U P F OH | 3068 |
| Zervamicin_ZIB | * Ac W V E J I T U L U O Q U O U P F OH | 3069 |
| Zervamicin_ZIB' | * Ac W I E U I T U L U O Q U O U P F OH | 3070 |
| Zervamicin_ZIC | * Ac W I E J I T U L U O Q U O U P F OH | 3071 |
| Zervamicin_ZII-1 | * Ac W I Q U V T U L U O Q U O U P F OH | 3072 |
| Zervamicin_ZII-2 | * Ac W I Q U I T U V U O Q U O U P F OH | 3073 |
| Zervamicin_ZII-3 | * Ac W V Q U I T U L U O Q U O U P F OH | 3074 |
| Zervamicin_ZII-4 | * Ac W I Q J V T U L U O Q U O U P F OH | 3075 |
| Zervamicin_ZII-5 | * Ac W I Q J I T U V U O Q U O U P F OH | 3076 |
| Zervamicin_ZIIA | * Ac W I Q U I T U L U O Q U O U P F OH | 3077 |
| Zervamicin_ZIIB | * Ac W I Q J I T U L U O Q U O U P F OH | 3078 |
| CAMEL135 (CAM135) | GWRLIKKILRVFKGL | 3079 |
| Novispirin G2 | KNLRIIRKGIHIIKKY* | 3080 |
| B-33 | FKKFWKWFRRF | 3081 |
| B-34 | LKRFLKWFKRF | 3082 |
| B-35 | KLFKRWKHLFR | 3083 |
| B-36 | RLLKRFKHLFK | 3084 |
| B-37 | FKTFLKWLHRF | 3085 |
| B-38 | IKQLLHFFQRF | 3086 |
| B-39 | KLLQTFKQIFR | 3087 |
| B-40 | RILKELKNLFK | 3088 |
| B-41 | LKQFVHFIHRF | 3089 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| B-42 | VKTLLHIFQRF | 3090 |
| B-43 | KLVEQLKEIFR | 3091 |
| B-44 | RVLQEIKQILK | 3092 |
| B-45 | VKNLAELVHRF | 3093 |
| B-46 | ATHLLHALQRF | 3094 |
| B-47 | KLAENVKEILR | 3095 |
| B-48 | RALHEAKEALK | 3096 |
| B-49 | FHYFWHWFHRF | 3097 |
| B-50 | LYHFLHWFQRF | 3098 |
| B-51 | YLFQTWQHLFR | 3099 |
| B-52 | YLLTEFQHLFK | 3100 |
| B-53 | FKTFLQWLHRF | 3101 |
| B-54 | IKTLLHFFQRF | 3102 |
| B-55 | KLLQTFNQIFR | 3103 |
| B-56 | TILQSLKNIFK | 3104 |
| B-57 | LKQFVKFIHRF | 3105 |
| B-58 | VKQLLKIFNRF | 3106 |
| B-59 | KLVQQLKNIFR | 3107 |
| B-60 | RVLNQVKQILK | 3108 |
| B-61 | VKKLAKLVRRF | 3109 |
| B-62 | AKRLLKVLKRF | 3110 |
| B-63 | KLAQKVKRVLR | 3111 |
| B-64 | RALKRIKHVLK | 3112 |
| 1C-1 | RRRRWWW | 3113 |
| 1C-2 | RRWWRRW | 3114 |
| 1C-3 | RRRWWWR | 3115 |
| 1C-4 | RWRWRWR | 3116 |
| 2C-1 | RRRFWWR | 3117 |
| 2C-2 | RRWWRRF* | 3118 |
| 2C-3 | RRRWWWF* | 3119 |
| 2C-4 | RWRWRWF* | 3120 |
| 3C-1 | RRRRWWK | 3121 |
| 3C-2 | RRWWRRK | 3122 |
| 3C-3 | RRRWWWK | 3123 |
| 3C-4 | RWRWRWK | 3124 |
| 4C-1 | RRRKWWK | 3125 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| 4C-2 | RRWKRRK | 3126 |
| 4C-3 | RRRKWWK | 3127 |
| 4C-4 | RWRKRWK | 3128 |
| a-3 | LHLLHQLLHLLHQF* | 3129 |
| a-4 | AQAAHQAAHAAHQF* | 3130 |
| a-5 | KLKKLLKKLKKLLK | 3131 |
| a-6 | LKLLKKLLKLLKKF* | 3132 |
| a-7 | LQLLKQLLKLLKQF* | 3133 |
| a-8 | AQAAKQAAKAAKQF* | 3134 |
| a-9 | RWRRWWRHFHHFFH* | 3135 |
| a-10 | KLKKLLKRWRRWWR | 3136 |
| a-11 | RWRRLLKKLHHLLH* | 3137 |
| a-12 | KLKKLLKHLHHLLH* | 3138 |
| BD-1 | FVF RHK WVW KHR FLF | 3139 |
| BD-2 | VFI HRH VWV HKH VLF | 3140 |
| BD-3 | WR WR AR WR WR LR WR F | 3141 |
| BD-4 | WR IH LR AR LH VK FR F | 3142 |
| BD-5 | LR IH AR FK VH IR LK F | 3143 |
| BD-6 | FH IK FR VH LK VR FH F | 3144 |
| BD-7 | FH VK IH FR LH VK FH F | 3145 |
| BD-8 | LH IH AH FH VH IH LH F | 3146 |
| BD-9 | FK IH FR LK VH IR FK F | 3147 |
| BD-10 | FK AH IR FK LR VK FH F | 3148 |
| BD-11 | LK AK IK FK VK LK IK F | 3149 |
| BD-12 | WIW KHK FL HRH FLF | 3150 |
| BD-13 | VFL HRH VI KHK LVF | 3151 |
| BD-14 | FL HKH VL RHR IVF | 3152 |
| BD-15 | VF KHK IV HRH ILF | 3153 |
| BD-16 | FLF KH LFL HR IFF | 3154 |
| BD-17 | LF KH ILI HR VIF | 3155 |
| BD-18 | FL HKH LF KHK LF | 3156 |
| BD-19 | VF RHR FI HRH VF | 3157 |
| BD-20 | FI HK LV HKH VLF | 3158 |
| BD-21 | VL RH LF RHR IVF | 3159 |
| BD-22 | LV HK LIL RH LLF | 3160 |
| BD-23 | VF KR VLI HK LIF | 3161 |

TABLE 14-continued

Other illustrative antimicrobial peptides. AP numbers refer to ID in antimicrobial peptide database (http://aps.unmc.edu/AP/main.php).

| Effector | Structure/Sequence | SEQ ID No |
|---|---|---|
| BD-24 | IV RK FLF RHK VF | 3162 |
| BD-25 | VL KH VIA HKR LF | 3163 |
| BD-26 | FI RK FLF KH LF | 3164 |
| BD-27 | VI RH VWV RK LF | 3165 |
| BD-28 | FLF RHR F RHR LVF | 3166 |
| BD-29 | LFL HKH A KHK FLF | 3167 |
| BD-30 | F KHK F KHK FIF | 3168 |
| BD-31 | L RHR L RHR LIF | 3169 |
| BD-32 | LIL K FLF K FVF | 3170 |
| BD-33 | VLI R ILV R VIF | 3171 |
| BD-34 | F RHR F RHR F | 3172 |
| BD-35 | L KHK L KHK F | 3173 |
| BD-36 | F K F KHK LIF | 3174 |
| BD-37 | L R L RHR VLF | 3175 |
| BD-38 | F K FLF K FLF | 3176 |
| BD-39 | L R LFL R WLF | 3177 |
| BD-40 | F K FLF KHK F | 3178 |
| BD-41 | L R LFL RHR F | 3179 |
| BD-42 | F K FLF K F | 3180 |
| BD-43 | L R LFL R F | 3181 |
| AA-1 | HHFFHHFHHFFHHF* | 3182 |
| AA-2 | FHFFHHFFHFFHHF* | 3183 |
| AA-3 | KLLK-GAT-FHFFHHFFHFFHHF | 3184 |
| AA-4 | KLLK-FHFFHHFFHFFHHF | 3185 |
| AA-5 | FHFFHHFFHFFHHFKLLK | 3186 |
| RIP | YSPWTNF* | 3187 |
| Lariatin A (anti-mycobacteria) | c(Gly-Ser-Gln-Leu-Val-Tyr-Arg-Glu)-Trp-Val-Gly-His-Ser-Asn-Val-Ile-Lys-Pro | 3188 |
| Lariatin B (anti-mycobacteria) | c(Gly-Ser-Gln-Leu-Val-Tyr-Arg-Glu)-Trp-Val-Gly-His-Ser-Asn-Val-Ile-Lys-Gly-Pro-Pro | 3189 |

Abreviations:
U - Aminoisobutyric Acid (Aib);
J - Isovaline (Iva);
O - Hydroxyproline (Hyp);
Z - Ethylnorvaline (EtNor);
x or xx means L or I at that position;
Ac - optionally acetylated N-term;
OH, OCH3 - optional C-term; Alkane long chains are noted in brackets;
*optionally amidated C-terminus. Where protecting groups are shown, the gropus are optional. Conversely any of the peptides shown without protecting groups can, optionally bear one or more protecting groups. Where peptides are shown circularized, linear forms are also contemplated. Conversely, where linear peptides are shown circularlized versions are also contemplated.

In certain embodiments the antimicrobial peptide consists of or comprises the amino acid sequence of LL-37 (LLGD-FFRK SKEKIGKEFKRIVQRIKD FLRNL VPRTES, SEQ ID NO:3190) or a variant of LL-37. LL-37 is a cathelicidin anti-microbial corresponding to amino acids 134-170 of the human cationic antimicrobial protein 18 (hCAP18). In certain embodiments the antimicrobial peptide consists of or comprises the amino acid sequence of an LL-37 variant as described in U.S. Patent Publication No: 2009/0156499 A1). Illustrative variants comprise or consist of the amino acid sequence having at least 90%, 95%, or 98% sequence identity with the amino acid sequence FKRIVQRIKDFLRX$_1$ (SEQ ID NO:3191), where X$_1$ is selected from the group consisting of 0, 1, 2, 3, 4, 5, 6, 7, and 8 amino acids. In certain embodiments illustrative variants comprise or consist of the amino acid sequence having at least 90%, 95%, or 98% sequence identity with the amino acid sequence X$_1$RLFDKIRQVIRKFX$_2$ (SEQ ID NO:3192) where X$_1$ is 0, 1, 2, 3, 4, 5, 6, 7, or 8 amino acids and X$_2$ is 0, 1, 2, 3, 4, 5, 6, 7, 8, 9, 10, 11, 12, 13, 14, 15, or 16 amino acids.

In certain embodiments the antimicrobial peptide consists of or comprises the amino acid sequence of an LL-37 variant shown in Table 15.

TABLE 15

LL-37 peptide and variants.

| ID | Amino acid sequence | SEQ ID NO |
|---|---|---|
| LL-37 | LLGDFFRKSKEKIGKEFKRIVQRIKDFLRNLVPRTES | 3193 |
| Cys-LL-37 | CLLGDFFRKSKEKIGKEFKRIVQRIKDFLRNLVPRTES | 3194 |
| LL-37(17-32) | FKRIVQRIKDFLRNLV | 3195 |
| Cys-LL-37-Cys | CLLGDFFRKSKEKIGKEFKRIVQRIKDFLRNLVPRTESC | 3196 |
| LL-37FK-13 | FKRIVQRIKDFLR | 3197 |
| LL-37FKR | FKRIVQRIKDFLRNLVPRTES | 3198 |
| LL-37GKE | GKEFKRIVQRIKDFLRNLVPR | 3199 |
| LL-37KRI | KRIVQRIKDFLRNLVPRTES | 3200 |
| LL-37LLG | LLGDFFRKSKEKIGKEFKRIV | 3201 |
| LL-37RKS | RKSKEKIGKEFKRIVQRIKDFLRNLVPRTES | 3202 |
| LL-37SKE | SKEKIGKEFKRIVQRIKDFLR | 3203 |
| LL-37-Cys | LLGDFFRKSKEKIGKEFKRIVQRIKDFLRNLVPRTESC | 3204 |

A number of antimicrobial peptides are also disclosed in U.S. Pat. Nos. 7,271,239, 7,223,840, 7,176,276, 6,809,181, 6,699,689, 6,420,116, 6,358,921, 6,316,594, 6,235,973, 6,183,992, 6,143,498, 6,042,848, 6,040,291, 5,936,063, 5,830,993, 5,428,016, 5,424,396, 5,032,574, 4,623,733, which are incorporated herein by reference for the disclosure of particular antimicrobial peptides.

v. Ligands.

In certain embodiments the effector can comprise one or more ligands, epitope tags, and/or antibodies. In certain embodiments preferred ligands and antibodies include those that bind to surface markers on immune cells. Chimeric moieties utilizing such antibodies as effector molecules act as bifunctional linkers establishing an association between the immune cells bearing binding partner for the ligand or antibody and the target microorganism(s).

The terms "epitope tag" or "affinity tag" are used interchangeably herein, and used refers to a molecule or domain of a molecule that is specifically recognized by an antibody or other binding partner. The term also refers to the binding partner complex as well. Thus, for example, biotin or a biotin/avidin complex are both regarded as an affinity tag. In addition to epitopes recognized in epitope/antibody interactions, affinity tags also comprise "epitopes" recognized by other binding molecules (e.g. ligands bound by receptors), ligands bound by other ligands to form heterodimers or homodimers, His$_6$ bound by Ni-NTA, biotin bound by avidin, streptavidin, or anti-biotin antibodies, and the like.

Epitope tags are well known to those of skill in the art. Moreover, antibodies specific to a wide variety of epitope tags are commercially available. These include but are not limited to antibodies against the DYKDDDDK (SEQ ID NO:3205) epitope, c-myc antibodies (available from Sigma, St. Louis), the HNK-1 carbohydrate epitope, the HA epitope, the HSV epitope, the His$_4$ (SEQ ID NO:3206), His$_s$ (SEQ ID NO:3207), and His$_6$ (SEQ ID NO:3208) epitopes that are recognized by the His epitope specific antibodies (see, e.g., Qiagen), and the like. In addition, vectors for epitope tagging proteins are commercially available. Thus, for example, the pCMV-Tag1 vector is an epitope tagging vector designed for gene expression in mammalian cells. A target gene inserted into the pCMV-Tag1 vector can be tagged with the FLAG® epitope (N-terminal, C-terminal or internal tagging), the c-myc epitope (C-terminal) or both the FLAG (N-terminal) and c-myc (C-terminal) epitopes.

vi. Lipids and Liposomes.

In certain embodiments the effectors comprise one or more microparticles or nanoparticles that can be loaded with an effector agent (e.g., a pharmaceutical, a label, etc.). In certain embodiments the microparticles or nanoparticles are lipidic particles. Lipidic particles are microparticles or nanoparticles that include at least one lipid component forming a condensed lipid phase. Typically, a lipidic nanoparticle has preponderance of lipids in its composition. Various condensed lipid phases include solid amorphous or true crystalline phases; isomorphic liquid phases (droplets); and various hydrated mesomorphic oriented lipid phases such as liquid crystalline and pseudocrystalline bilayer phases (L-alpha, L-beta, P-beta, Lc), interdigitated bilayer phases, and nonlamellar phases (see, e.g., The Structure of Biological Membranes, ed. by P. Yeagle, CRC Press, Bora Raton, Fla., 1991). Lipidic microparticles include, but are not limited to a liposome, a lipid-nucleic acid complex, a lipid-drug complex, a lipid-label complex, a solid lipid particle, a microemulsion droplet, and the like. Methods of making and using these types of lipidic microparticles and nanoparticles, as well as attachment of affinity moieties, e.g., antibodies, to them are known in the art (see, e.g., U.S. Pat. Nos. 5,077,057; 5,100,591; 5,616,334; 6,406,713; 5,576,016; 6,248,363; Bondi et al. (2003) Drug Delivery 10: 245-250; Pedersen et al., (2006) Eur. J. Pharm. Biopharm. 62: 155-162, 2006 (solid lipid particles); U.S. Pat. Nos. 5,534,502; 6,720,001; Shiokawa et al. (2005) Clin. Cancer Res. 11: 2018-2025 (microemulsions); U.S. Pat. No. 6,071,533 (lipid-nucleic acid complexes), and the like).

A liposome is generally defined as a particle comprising one or more lipid bilayers enclosing an interior, typically an aqueous interior. Thus, a liposome is often a vesicle formed by a bilayer lipid membrane. There are many methods for the preparation of liposomes. Some of them are used to prepare small vesicles (d<0.05 micrometer), some for larger vesicles (d>0.05 micrometer). Some are used to prepare multilamellar vesicles, some for unilamellar ones. Methods for liposome preparation are exhaustively described in several review articles such as Szoka and Papahadjopoulos (1980) *Ann. Rev. Biophys. Bioeng.*, 9: 467, Deamer and Uster (1983) Pp. 27-51 In: *Liposomes*, ed. M. J. Ostro, Marcel Dekker, New York, and the like.

In various embodiments the liposomes include a surface coating of a hydrophilic polymer chain. "Surface-coating" refers to the coating of any hydrophilic polymer on the surface of liposomes. The hydrophilic polymer is included in the liposome by including in the liposome composition one or more vesicle-forming lipids derivatized with a hydrophilic polymer chain. In certain embodiments, vesicle-forming lipids with diacyl chains, such as phospholipids, are preferred. One illustrative phospholipid is phosphatidylethanolamine (PE), which contains a reactive amino group convenient for coupling to the activated polymers. One illustrative PE is distearoyl PE (DSPE). Another example is non-phospholipid double chain amphiphilic lipids, such as diacyl- or dialkylglycerols, derivatized with a hydrophilic polymer chain.

In certain embodiments a hydrophilic polymer for use in coupling to a vesicle forming lipid is polyethyleneglycol (PEG), preferably as a PEG chain having a molecular weight between 1,000-10,000 Daltons, more preferably between 1,000-5,000 Daltons, most preferably between 2,000-5,000 Daltons. Methoxy or ethoxy-capped analogues of PEG are also useful hydrophilic polymers, commercially available in a variety of polymer sizes, e.g., 120-20,000 Daltons.

Other hydrophilic polymers that can be suitable include, but are not limited to polylactic acid, polyglycolic acid, polyvinylpyrrolidone, polymethyloxazoline, polyethyloxazoline, polyhydroxypropyl methacrylamide, polymethacrylamide, polydimethylacrylamide, and derivatized celluloses, such as hydroxymethylcellulose or hydroxyethylcellulose.

Preparation of lipid-polymer conjugates containing these polymers attached to a suitable lipid, such as PE, have been described.

The liposomes can, optionally be prepared for attachment to one or more targeting moieties described herein. Here the lipid component included in the liposomes would include either a lipid derivatized with the targeting moiety, or a lipid having a polar-head chemical group, e.g., on a linker, that can be derivatized with the targeting moiety in preformed liposomes, according to known methods.

Methods of functionalizing lipids and liposomes with affinity moieties such as antibodies are well known to those of skill in the art (see, e.g., DE 3,218,121; Epstein et al. (1985) *Proc. Natl. Acad. Sci., USA*, 82:3688 (1985); Hwang et al. (1980) *Proc. Natl. Acad. Sci., USA*, 77: 4030; EP 52,322; EP 36,676; EP 88,046; EP 143,949; EP 142,641; Japanese patent application 83-118008; U.S. Pat. Nos. 4,485,045 and 4,544, 545; and EP 102,324, all of which are incorporated herein by reference).

vii. Agents that Physically Disrupt the Extracellular Matrix within a Community of Microorganisms In certain embodiments, peptides can be coupled to agents that physically disrupt the extracellular matrix within a community of microorganisms, for example a biofilm. In certain preferred embodiments, such an agent could be a bacterial cell-wall degrading enzyme, for example SAL-2, or any species of glycosidase, alginase, peptidase, proteinase, lipase, or DNA or RNA degrading enzyme or compound, for example rhRNase. Disruption of extracellular matrix of biofilms can result in clearance and therapeutic benefit.

Peptides can also be attached to antimicrobial proteins, such as Protein Inhibitor C or Colicin, or fragments thereof, for example the IIa domain of Colicin, or the heparin-binding domain of Protein Inhibitor C.

viii. Polymeric Microparticles and/or Nanoparticles.

In certain embodiments the effector(s) comprise polymeric microparticles and/or nanoparticles and/or micelles.

Microparticle and nanoparticle-based drug delivery systems have considerable potential for treatment of various microorganisms. Technological advantages of polymeric microparticles or nanoparticles used as drug carriers are high stability, high carrier capacity, feasibility of incorporation of both hydrophilic and hydrophobic substances, and feasibility of variable routes of administration, including oral application and inhalation. Polymeric nanoparticles can also be designed to allow controlled (sustained) drug release from the matrix. These properties of nanoparticles enable improvement of drug bioavailability and reduction of the dosing frequency.

Polymeric nanoparticles are typically micron or submicron (<1 μm) colloidal particles. This definition includes monolithic nanoparticles (nanospheres) in which the drug is adsorbed, dissolved, or dispersed throughout the matrix and nanocapsules in which the drug is confined to an aqueous or oily core surrounded by a shell-like wall. Alternatively, in certain embodiments, the drug can be covalently attached to the surface or into the matrix.

Polymeric microparticles and nanoparticles are typically made from biocompatible and biodegradable materials such as polymers, either natural (e.g., gelatin, albumin) or synthetic (e.g., polylactides, polyalkylcyanoacrylates), or solid lipids. In the body, the drug loaded in nanoparticles is usually released from the matrix by diffusion, swelling, erosion, or degradation. One commonly used material is poly(lactide-coglycolide) (PLG).

Methods of fabricating and loading polymeric nanoparticles or microparticles are well known to those of skill in the art. Thus, for example, Matsumoto et al. (1999) *Intl. J. Pharmaceutics*, 185: 93-101 teaches the fabrication of poly(L-lactide)-poly(ethylene glycol)-poly(L-lactide) nanoparticles, Chawla et al. (2002) *Intl. J. Pharmaceutics* 249: 127-138, teaches the fabrication and use of poly(ε-caprolactone) nanoparticles delivery of tamifoxen, and Bodmeier et al. (1988) *Intl. J. Pharmaceutics*, 43: 179-186, teaches the preparation of poly(D,L-lactide) microspheres using a solvent evaporation method. "Intl. J. Pharmaceutics, 1988, 43, 179-186. Other nanoparticle formulations are described, for example, by Williams et al. (2003) *J. Controlled Release*, 91: 167-172; Leroux et al. (1996) *J. Controlled Release*, 39: 339-350; Soppimath et al. (2001) *J. Controlled Release*, 70:1-20; Brannon-Peppas (1995) *Intl. J. Pharmaceutics*, 116: 1-9; and the like.

C) Peptide Preparation.

The peptides described herein can be chemically synthesized using standard chemical peptide synthesis techniques or, particularly where the peptide does not comprise "D" amino acid residues, the peptide can be recombinantly expressed. Where the "D" polypeptides are recombinantly expressed, a host organism (e.g. bacteria, plant, fungal cells, etc.) can be cultured in an environment where one or more of the amino acids is provided to the organism exclusively in a D form. Recombinantly expressed peptides in such a system then incorporate those D amino acids.

In certain embodiments, D amino acids can be incorporated in recombinantly expressed peptides using modified amino acyl-tRNA synthetases that recognize D-amino acids.

In certain embodiments the peptides are chemically synthesized by any of a number of fluid or solid phase peptide synthesis techniques known to those of skill in the art. Solid phase synthesis in which the C-terminal amino acid of the sequence is attached to an insoluble support followed by sequential addition of the remaining amino acids in the sequence is a preferred method for the chemical synthesis of the polypeptides of this invention. Techniques for solid phase synthesis are well known to those of skill in the art and are described, for example, by Barany and Merrifield (1963) *Solid-Phase Peptide Synthesis*; pp. 3-284 in *The Peptides: Analysis, Synthesis, Biology. Vol.* 2: *Special Methods in Peptide Synthesis, Part A.*; Merrifield et al. (1963) *J. Am. Chem. Soc.,* 85: 2149-2156, and Stewart et al. (1984) *Solid Phase Peptide Synthesis,* 2nd ed. Pierce Chem. Co., Rockford, Ill.

In one embodiment, the peptides can be synthesized by the solid phase peptide synthesis procedure using a benzhyderylamine resin (Beckman Bioproducts, 0.59 mmol of $NH_2$/g of resin) as the solid support. The COOH terminal amino acid (e.g., t-butylcarbonyl-Phe) is attached to the solid support through a 4-(oxymethyl)phenacetyl group. This is a more stable linkage than the conventional benzyl ester linkage, yet the finished peptide can still be cleaved by hydrogenation. Transfer hydrogenation using formic acid as the hydrogen donor can be used for this purpose.

It is noted that in the chemical synthesis of peptides, particularly peptides comprising D amino acids, the synthesis usually produces a number of truncated peptides in addition to the desired full-length product. Thus, the peptides are typically purified using, e.g., HPLC.

D-amino acids, beta amino acids, non-natural amino acids, and the like can be incorporated at one or more positions in the peptide simply by using the appropriately derivatized amino acid residue in the chemical synthesis. Modified residues for solid phase peptide synthesis are commercially available from a number of suppliers (see, e.g., Advanced Chem Tech, Louisville; Nova Biochem, San Diego; Sigma, St Louis; Bachem California Inc., Torrance, etc.). The D-form and/or otherwise modified amino acids can be completely omitted or incorporated at any position in the peptide as desired. Thus, for example, in certain embodiments, the peptide can comprise a single modified acid, while in other embodiments, the peptide comprises at least two, generally at least three, more generally at least four, most generally at least five, preferably at least six, more preferably at least seven or even all modified amino acids. In certain embodiments, essentially every amino acid is a D-form amino acid.

As indicated above, the peptides and/or fusion proteins of this invention can also be recombinantly expressed. Accordingly, in certain embodiments, the antimicrobial peptides and/or targeting moieties, and/or fusion proteins of this invention are synthesized using recombinant expression systems. Generally this involves creating a DNA sequence that encodes the desired peptide or fusion protein, placing the DNA in an expression cassette under the control of a particular promoter, expressing the peptide or fusion protein in a host, isolating the expressed peptide or fusion protein and, if required, renaturing the peptide or fusion protein.

DNA encoding the peptide(s) or fusion protein(s) described herein can be prepared by any suitable method as described above, including, for example, cloning and restriction of appropriate sequences or direct chemical synthesis.

This nucleic acid can be easily ligated into an appropriate vector containing appropriate expression control sequences (e.g. promoter, enhancer, etc.), and, optionally, containing one or more selectable markers (e.g. antibiotic resistance genes).

The nucleic acid sequences encoding the peptides or fusion proteins described herein can be expressed in a variety of host cells, including, but not limited to, *E. coli*, other bacterial hosts, yeast, fungus, and various higher eukaryotic cells such as insect cells (e.g. SF3), the COS, CHO and HeLa cells lines and myeloma cell lines. The recombinant protein gene will typically be operably linked to appropriate expression control sequences for each host. For *E. coli* this can include a promoter such as the T7, tip, or lambda promoters, a ribosome binding site and preferably a transcription termination signal. For eukaryotic cells, the control sequences can include a promoter and often an enhancer (e.g., an enhancer derived from immunoglobulin genes, SV40, cytomegalovirus, etc.), and a polyadenylation sequence, and may include splice donor and acceptor sequences.

The plasmids can be transferred into the chosen host cell by well-known methods such as calcium chloride transformation for *E. coli* and calcium phosphate treatment or electroporation for mammalian cells. Cells transformed by the plasmids can be selected by resistance to antibiotics conferred by genes contained on the plasmids, such as the amp, gpt, neo and hyg genes.

Once expressed, the recombinant peptide(s) or fusion protein(s) can be purified according to standard procedures of the art, including ammonium sulfate precipitation, affinity columns, column chromatography, gel electrophoresis and the like (see, generally, R. Scopes, (1982) *Protein Purification,* Springer-Verlag, N.Y.; Deutscher (1990) *Methods in Enzymology Vol.* 182: *Guide to Protein Purification.*, Academic Press, Inc. N.Y.). Substantially pure compositions of at least about 90 to 95% homogeneity are preferred, and 98 to 99% or more homogeneity are most preferred.

One of skill in the art would recognize that after chemical synthesis, biological expression, or purification, the peptide(s) or fusion protein(s) may possess a conformation substantially different than desired native conformation. In this case, it may be necessary to denature and reduce the peptide or fusion protein and then to cause the molecule to re-fold into the preferred conformation. Methods of reducing and denaturing proteins and inducing re-folding are well known to those of skill in the art (see, e.g., Debinski et al. (1993) *J. Biol. Chem.,* 268: 14065-14070; Kreitman and Pastan (1993) *Bioconjug. Chem.,* 4: 581-585; and Buchner, et al., (1992) *Anal. Biochem.,* 205: 263-270). Debinski et al., for example, describes the denaturation and reduction of inclusion body proteins in guanidine-DTE. The protein is then refolded in a redox buffer containing oxidized glutathione and L-arginine.

One of skill would recognize that modifications can be made to the peptide(s) and/or fusion protein(s) proteins without diminishing their biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids (e.g., poly His) placed on either terminus to create conveniently located restriction sites or termination codons or purification sequences.

D) Joining Targeting Moieties to Effectors.

i. Chemical Conjugation.

Chimeric moieties are formed by joining one or more of the targeting moieties described herein to one or more effectors. In certain embodiments the targeting moieties are attached directly to the effector(s) via naturally occurring reactive groups or the targeting moiety and/or the effector(s) can be functionalized to provide such reactive groups.

In various embodiments the targeting moieties are attached to effector(s) via one or more linking agents. Thus, in various embodiments the targeting moieties and the effector(s) can be conjugated via a single linking agent or multiple linking agents. For example, the targeting moiety and the effector can be conjugated via a single multifunctional (e.g., bi-, tri-, or tetra-) linking agent or a pair of complementary linking agents. In another embodiment, the targeting moiety and the effector are conjugated via two, three, or more linking agents. Suitable linking agents include, but are not limited to, e.g., functional groups, affinity agents, stabilizing groups, and combinations thereof.

In certain embodiments the linking agent is or comprises a functional group. Functional groups include monofunctional linkers comprising a reactive group as well as multifunctional crosslinkers comprising two or more reactive groups capable of forming a bond with two or more different functional targets (e.g., labels, proteins, macromolecules, semiconductor nanocrystals, or substrate). In some preferred embodiments, the multifunctional crosslinkers are heterobifunctional crosslinkers comprising two or more different reactive groups.

Suitable reactive groups include, but are not limited to thiol (—SH), carboxylate (COOH), carboxyl (—COOH), carbonyl, amine ($NH_2$), hydroxyl (—OH), aldehyde (—CHO), alcohol (ROH), ketone ($R_2CO$), active hydrogen, ester, sulfhydryl (SH), phosphate (—$PO_3$), or photoreactive moieties. Amine reactive groups include, but are not limited to e.g., isothiocyanates, isocyanates, acyl azides, NHS esters, sulfonyl chlorides, aldehydes and glyoxals, epoxides and oxiranes, carbonates, arylating agents, imidoesters, carbodiimides, and anhydrides. Thiol-reactive groups include, but are not limited to e.g., haloacetyl and alkyl halide derivates, maleimides, aziridines, acryloyl derivatives, arylating agents, and thiol-disulfides exchange reagents. Carboxylate reactive groups include, but are not limited to e.g., diazoalkanes and diazoacetyl compounds, such as carbonyldiimidazoles and carbodiimides. Hydroxyl reactive groups include, but are not limited to e.g., epoxides and oxiranes, carbonyldiimidazole, oxidation with periodate, N,N'-disuccinimidyl carbonate or N-hydroxylsuccimidyl chloroformate, enzymatic oxidation, alkyl halogens, and isocyanates. Aldehyde and ketone reactive groups include, but are not limited to e.g., hydrazine derivatives for schiff base formation or reduction amination. Active hydrogen reactive groups include, but are not limited to e.g., diazonium derivatives for mannich condensation and iodination reactions. Photoreactive groups include, but are not limited to e.g., aryl azides and halogenated aryl azides, benzophenones, diazo compounds, and diazirine derivatives.

Other suitable reactive groups and classes of reactions useful in forming chimeric moieties include those that are well known in the art of bioconjugate chemistry. Currently favored classes of reactions available with reactive chelates are those which proceed under relatively mild conditions. These include, but are not limited to, nucleophilic substitutions (e.g., reactions of amines and alcohols with acyl halides, active esters), electrophilic substitutions (e.g., enamine reactions), and additions to carbon-carbon and carbon-heteroatom multiple bonds (e.g., Michael reaction, Diels-Alder addition). These and other useful reactions are discussed in, for example, March (1985) *Advanced Organic Chemistry*, 3rd Ed., John Wiley & Sons, New York, Hermanson (1996) *Bioconjugate Techniques*, Academic Press, San Diego; and Feeney et al. (1982) *Modification of Proteins; Advances in Chemistry Series*, Vol. 198, American Chemical Society, Washington, D.C.

In certain embodiments, the linking agent comprises a chelator. For example, the chelator comprising the molecule, DOTA (DOTA=1,4,7,10-tetrakis(carboxymethyl)-1,4,7,10-tetraazacyclododecane), can readily be labeled with a radiolabel, such as $Gd^{3+}$ and $^{64}Cu$, resulting in $Gd^{3+}$-DOTA and $^{64}Cu$-DOTA respectively, attached to the targeting moiety. Other suitable chelates are known to those of skill in the art, for example, 1,4,7-triazacyclononane-N,N',N"-triacetic acid (NOTA) derivatives being among the most well known (see, e.g., Lee et al. (1997) *Nucl Med. Biol.* 24: 2225-23019).

A "linker" or "linking agent" as used herein, is a molecule that is used to join two or more molecules. In certain embodiments the linker is typically capable of forming covalent bonds to both molecule(s) (e.g., the targeting moiety and the effector). Suitable linkers are well known to those of skill in the art and include, but are not limited to, straight or branched-chain carbon linkers, heterocyclic carbon linkers, or peptide linkers. In certain embodiments the linkers can be joined to the constituent amino acids through their side groups (e.g., through a disulfide linkage to cysteine). However, in certain embodiments, the linkers will be joined to the alpha carbon amino and carboxyl groups of the terminal amino acids.

A bifunctional linker having one functional group reactive with a group on one molecule (e.g., a targeting peptide), and another group reactive on the other molecule (e.g., an antimicrobial peptide), can be used to form the desired conjugate. Alternatively, derivatization can be performed to provide functional groups. Thus, for example, procedures for the generation of free sulfhydryl groups on peptides are also known (See U.S. Pat. No. 4,659,839).

In certain embodiments the linking agent is a heterobifunctional crosslinker comprising two or more different reactive groups that form a heterocyclic ring that can interact with a peptide. For example, a heterobifunctional crosslinker such as cysteine may comprise an amine reactive group and a thiol-reactive group can interact with an aldehyde on a derivatized peptide. Additional combinations of reactive groups suitable for heterobifunctional crosslinkers include, for example, amine- and sulfhydryl reactive groups; carbonyl and sulfhydryl reactive groups; amine and photoreactive groups; sulfhydryl and photoreactive groups; carbonyl and photoreactive groups; carboxylate and photoreactive groups; and arginine and photoreactive groups. In one embodiment, the heterobifunctional crosslinker is SMCC.

Many procedures and linker molecules for attachment of various molecules to peptides or proteins are known (see, e.g., European Patent Application No. 188,256; U.S. Pat. Nos. 4,671,958, 4,659,839, 4,414,148, 4,699,784; 4,680,338; 4,569,789; and 4,589,071; and Borlinghaus et al. (1987) *Cancer Res.* 47: 4071-4075). Illustrative linking protocols are provided herein in Examples 2 and 3.

ii. Fusion Proteins.

In certain embodiments where the targeting moiety and effector are both peptides or both comprise peptides, the chimeric moiety can be chemically synthesized or recombinantly expressed as a fusion protein (i.e., a chimeric fusion protein).

In certain embodiments the chimeric fusion proteins are synthesized using recombinant DNA methodology. Generally this involves creating a DNA sequence that encodes the fusion protein, placing the DNA in an expression cassette under the control of a particular promoter, expressing the protein in a host, isolating the expressed protein and, if required, renaturing the protein.

DNA encoding the fusion proteins can be prepared by any suitable method, including, for example, cloning and restriction of appropriate sequences or direct chemical synthesis by methods such as the phosphotriester method of Narang et al. (1979) *Meth. Enzymol.* 68: 90-99; the phosphodiester method of Brown et al. (1979) *Meth. Enzymol.* 68: 109-151; the diethylphosphoramidite method of Beaucage et al. (1981) *Tetra. Lett.*, 22: 1859-1862; and the solid support method of U.S. Pat. No. 4,458,066.

Chemical synthesis produces a single stranded oligonucleotide. This can be converted into double stranded DNA by hybridization with a complementary sequence or by polymerization with a DNA polymerase using the single strand as a template. One of skill would recognize that while chemical synthesis of DNA is limited to sequences of about 100 bases, longer sequences can be obtained by the ligation of shorter sequences.

Alternatively, subsequences can be cloned and the appropriate subsequences cleaved using appropriate restriction enzymes. The fragments can then be ligated to produce the desired DNA sequence.

In certain embodiments, DNA encoding fusion proteins of the present invention may be cloned using DNA amplification methods such as polymerase chain reaction (PCR). Thus, for example, the nucleic acid encoding a targeting antibody, a targeting peptide, and the like is PCR amplified, using a sense primer containing the restriction site for NdeI and an antisense primer containing the restriction site for HindIII. This produces a nucleic acid encoding the targeting sequence and having terminal restriction sites. Similarly an effector and/or effector/linker/spacer can be provided having complementary restriction sites. Ligation of sequences and insertion into a vector produces a vector encoding the fusion protein.

While the targeting moieties and effector(s) can be directly joined together, one of skill will appreciate that they can be separated by a peptide spacer/linker consisting of one or more amino acids. Generally the spacer will have no specific biological activity other than to join the proteins or to preserve some minimum distance or other spatial relationship between them. However, the constituent amino acids of the spacer may be selected to influence some property of the molecule such as the folding, net charge, or hydrophobicity.

The nucleic acid sequences encoding the fusion proteins can be expressed in a variety of host cells, including *E. coli*, other bacterial hosts, yeast, and various higher eukaryotic cells such as the COS, CHO and HeLa cells lines and myeloma cell lines. The recombinant protein gene will be operably linked to appropriate expression control sequences for each host. For *E. coli* this includes a promoter such as the T7, tip, or lambda promoters, a ribosome binding site and preferably a transcription termination signal. For eukaryotic cells, the control sequences will include a promoter and preferably an enhancer derived from immunoglobulin genes, SV40, cytomegalovirus, etc., and a polyadenylation sequence, and may include splice donor and acceptor sequences.

The plasmids can be transferred into the chosen host cell by well-known methods such as calcium chloride transformation for *E. coli* and calcium phosphate treatment or electroporation for mammalian cells. Cells transformed by the plasmids can be selected by resistance to antibiotics conferred by genes contained on the plasmids, such as the amp, gpt, neo and hyg genes.

Once expressed, the recombinant fusion proteins can be purified according to standard procedures of the art, including ammonium sulfate precipitation, affinity columns, column chromatography, gel electrophoresis and the like (see, generally, R. Scopes (1982) *Protein Purification*, Springer-Verlag, N.Y.; Deutscher (1990) *Methods in Enzymology Vol. 182: Guide to Protein Purification.*, Academic Press, Inc. N.Y.). Substantially pure compositions of at least about 90 to 95% homogeneity are preferred, and 98 to 99% or more homogeneity are most preferred for pharmaceutical uses. Once purified, partially or to homogeneity as desired, the polypeptides may then be used therapeutically.

One of skill in the art would recognize that after chemical synthesis, biological expression, or purification, the fusion protein may possess a conformation substantially different than the native conformations of the constituent polypeptides. In this case, it may be necessary to denature and reduce the polypeptide and then to cause the polypeptide to re-fold into the preferred conformation. Methods of reducing and denaturing proteins and inducing re-folding are well known to those of skill in the art (See, Debinski et al. (1993) *J. Biol. Chem.*, 268: 14065-14070; Kreitman and Pastan (1993) *Bioconjug. Chem.*, 4: 581-585; and Buchner, et al. (1992) *Anal. Biochem.*, 205: 263-270).

One of skill would recognize that modifications can be made to the fusion proteins without diminishing their biological activity. Some modifications may be made to facilitate the cloning, expression, or incorporation of the targeting molecule into a fusion protein. Such modifications are well known to those of skill in the art and include, for example, a methionine added at the amino terminus to provide an initiation site, or additional amino acids placed on either terminus to create conveniently located restriction sites or termination codons.

As indicated above, in various embodiments a peptide linker/spacer is used to join the one or more targeting moieties to one or more effector(s). In various embodiments the peptide linker is relatively short, typically less than about 10 amino acids, preferably less than about 8 amino acids and more preferably about 3 to about 5 amino acids. Suitable illustrative linkers include, but are not limited to PSGSP ((SEQ ID NO:3209), ASASA (SEQ ID NO: 3210), or GGG. In certain embodiments longer linkers such as (GGGGS)$_3$ (SEQ ID NO:3211) can be used. Illustrative peptide linkers and other linkers are shown in Table 16.

TABLE 16

Illustrative peptide and non-peptide linkers.

| Linker | SEQ ID NO: |
|---|---|
| AAA | |
| GGG | |
| GGGG | 3212 |
| SGG | |
| GGSGGS | 3213 |
| SAT | |
| PYP | |
| PSPSP | 3214 |
| ASA | |
| ASASA | 3215 |
| PSPSP | 3216 |

TABLE 16-continued

Illustrative peptide and non-peptide linkers.

| Linker | SEQ ID NO: |
|---|---|
| KKKK | 3217 |
| RRRR | 3218 |
| GGGGS | 3219 |
| GGGGS GGGGS | 3220 |
| GGGGS GGGGS GGGGS | 3221 |
| GGGGS GGGGS GGGGS GGGGS | 3222 |
| GGGGS GGGGS GGGGS GGGGS GGGGS | 3223 |
| GGGGS GGGGS GGGGS GGGGS GGGGS GGGGS | 3224 |
| 2-nitrobenzene or O-nitrobenzyl | |
| Nitropyridyl disulfide | |
| Dioleoylphosphatidylethanolamine (DOPE) | |
| S-acetylmercaptosuccinic acid | |
| 1,4,7,10-tetraazacyclododecane-1,4,7,10-tetracetic acid (DOTA) | |
| β-glucuronide and β-glucuronide variants | |
| Poly(alkylacrylic acid) | |
| Benzene-based linkers (for example: 2,5-Bis(hexyloxy)-1,4-bis[2,5-bis(hexyloxy)-4-formyl-phenylenevinylene]benzene) and like molecules | |
| Disulfide linkages | |
| Poly(amidoamine) or like dendrimers linking multiple target and killing peptides in one molecule | |
| Carbon nanotubes | |
| Hydrazone and hydrazone variant linkers | |
| PEG of any chain length | |
| Succinate, formate, acetate butyrate, other like organic acids | |
| Aldols, alcohols, or enols | |
| Peroxides | |
| alkane or alkene groups of any chain length | |
| One or more porphyrin or dye molecules containing free amide and carboxylic acid groups | |
| One or more DNA or RNA nucleotides, including polyamine and polycarboxyl-containing variants | |
| Inulin, sucrose, glucose, or other single, di or polysaccharides | |
| Linoleic acid or other polyunsaturated fatty acids | |
| Variants of any of the above linkers containing halogen or thiol groups | |

(All amino-acid-based linkers could be L, D, combinations of L and D forms, β-form, and the like)

E) Multiple Targeting Moieties and/or Effectors.

Figure 14:
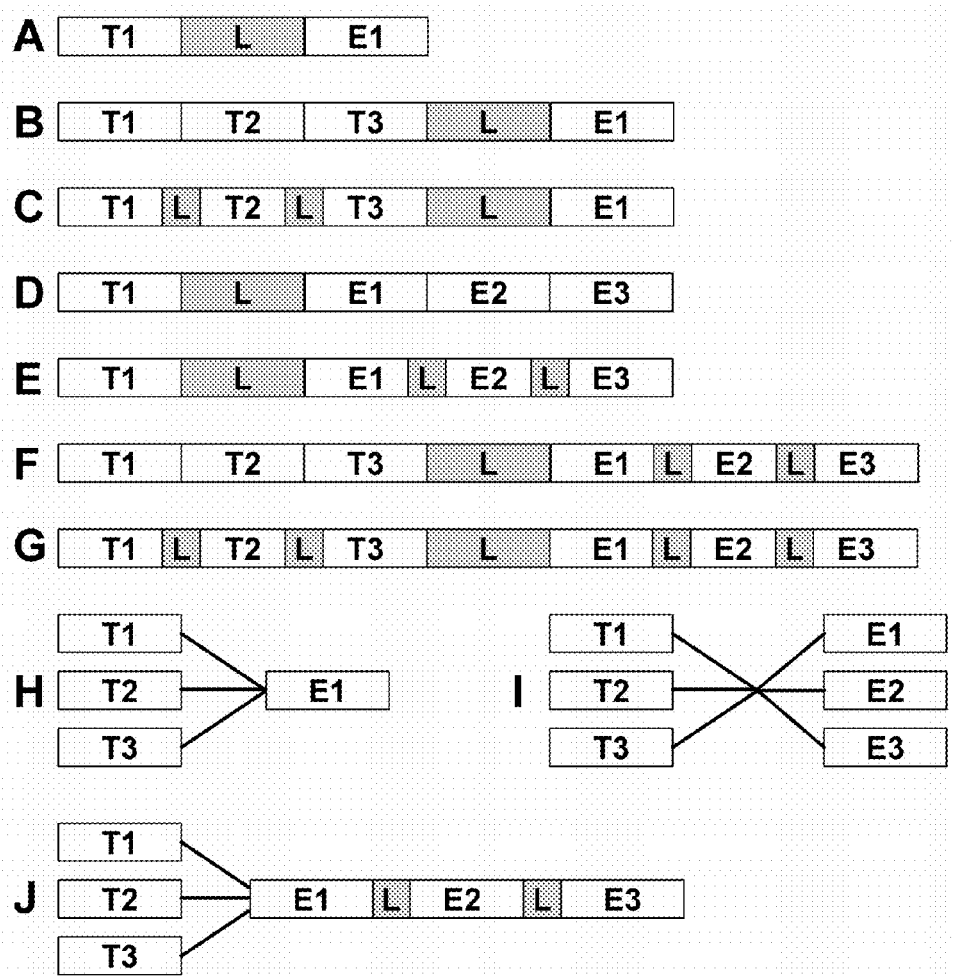
FIG. 14 schematically shows some illustrative configurations for chimeric constructs described herein. A: Shows a single targeting moiety T1 attached to a single effector E1 by a linker/spacer L. B: Shows multiple targeting moieties T1, T2, T3 attached directly to each other and attached by a linker L to a single effector E1. In various embodiments T1, T2, and T3, can be domains in a fusion protein. C: Shows multiple targeting moieties T1, T2, T3 attached to each other by linkers L and attached by a linker L to a single effector E1. In various embodiments T1, T2, and T3, can be domains in a fusion protein. D: Shows a single targeting moiety T1 attached by a linker L to multiple effectors E1, E2, and E3 joined directly to each other. E: Shows a single targeting moiety T1 attached by a linker L to multiple effectors E1, E2, and E3 joined to each other by linkers L. F: Shows multiple targeting moieties joined directly to each other and by a linker L to multiple effectors joined to each other by linkers L. G: Shows multiple targeting moieties joined to each other by linkers L and by a linker L to multiple effectors joined to each other by linkers L. In various embodiments T1, T2, and T3, and/or E1, E2, and E3 can be domains in a fusion protein. H: Illustrates a branched configuration where multiple targeting moieties are linked to a single effector. I: Illustrates a dual branched configuration where multiple targeting moieties are linked to multiple effectors. J: Illustrates a branched configuration where multiple targeting moieties are linked to multiple effectors where the effectors are joined to each other in a linear configuration.

As indicated above, in certain embodiments, the chimeric moieties described herein comprise multiple targeting moieties attached to a single effector or multiple effectors attached to a single targeting moiety, or multiple targeting moieties attached to multiple effectors.

Where the chimeric construct is a fusion protein this is easily accomplished by providing multiple domains that are targeting domains attached to one or more effector domains. FIG. 14 schematically illustrates a few, but not all, configurations. In various embodiments the multiple targeting domains and/or multiple effector domains can be attached to each other directly or can be separated by linkers (e.g., amino acid or peptide linkers as described above).

When the chimeric construct is a chemical conjugate linear or branched configurations (e.g., as illustrated in FIG. 14) are readily produced by using branched or multifunctional linkers and/or a plurality of different linkers.

F) Protecting Groups.

While the various peptides (e.g., targeting peptides, antimicrobial peptides, STAMPs) described herein may be shown with no protecting groups, in certain embodiments they can bear one, two, three, four, or more protecting groups. In various embodiments, the protecting groups can be coupled to the C- and/or N-terminus of the peptide(s) and/or to one or more internal residues comprising the peptide(s) (e.g., one or more R-groups on the constituent amino acids can be blocked). Thus, for example, in certain embodiments, any of the peptides described herein can bear, e.g., an acetyl group protecting the amino terminus and/or an amide group protecting the carboxyl terminus. One example of such a protected peptide is the 1845L6-21 STAMP having the amino acid sequence KFINGVLSQFVLERKPYPKLFKFLRKHLL* (SEQ ID NO:3225), where the asterisk indicates an amidated carboxyl terminus. Of course, this protecting group can be can be eliminated and/or substituted with another protecting group as described herein.

Without being bound by a particular theory, it was discovered that addition of a protecting group, particularly to the carboxyl and in certain embodiments the amino terminus can improve the stability and efficacy of the peptide.

A wide number of protecting groups are suitable for this purpose. Such groups include, but are not limited to acetyl, amide, and alkyl groups with acetyl and alkyl groups being particularly preferred for N-terminal protection and amide groups being preferred for carboxyl terminal protection. In certain particularly preferred embodiments, the protecting groups include, but are not limited to alkyl chains as in fatty acids, propionyl, formyl, and others. Particularly preferred carboxyl protecting groups include amides, esters, and ether-forming protecting groups. In one preferred embodiment, an acetyl group is used to protect the amino terminus and an amide group is used to protect the carboxyl terminus. These blocking groups enhance the helix-forming tendencies of the peptides. Certain particularly preferred blocking groups include alkyl groups of various lengths, e.g., groups having the formula: $CH_3-(CH_2)_n-CO-$ where n ranges from about 1 to about 20, preferably from about 1 to about 16 or 18, more preferably from about 3 to about 13, and most preferably from about 3 to about 10.

In certain embodiments, the protecting groups include, but are not limited to alkyl chains as in fatty acids, propionyl, formyl, and others. Particularly preferred carboxyl protecting groups include amides, esters, and ether-forming protecting groups. In one embodiment, an acetyl group is used to protect the amino terminus and/or an amino group is used to protect the carboxyl terminus (i.e., amidated carboxyl terminus). In certain embodiments blocking groups include alkyl groups of various lengths, e.g., groups having the formula: $CH_3$—$(CH_2)_n$—CO— where n ranges from about 3 to about 20, preferably from about 3 to about 16, more preferably from about 3 to about 13, and most preferably from about 3 to about 10.

In certain embodiments, the acid group on the C-terminal can be blocked with an alcohol, aldehyde or ketone group and/or the N-terminal residue can have the natural amide group, or be blocked with an acyl, carboxylic acid, alcohol, aldehyde, or ketone group.

Other protecting groups include, but are not limited to Fmoc, t-butoxycarbonyl (t-BOC), 9-fluoreneacetyl group, 1-fluorenecarboxylic group, 9-florenecarboxylic group, 9-fluorenone-1-carboxylic group, benzyloxycarbonyl, xanthyl (Xan), trityl (Trt), 4-methyltrityl (Mtt), 4-methoxytrityl (Mmt), 4-methoxy-2,3,6-trimethyl-benzenesulphonyl (Mtr), Mesitylene-2-sulphonyl (Mts), 4,4-dimethoxybenzhydryl (Mbh), Tosyl (Tos), 2,2,5,7,8-pentamethyl chroman-6-sulphonyl (Pmc), 4-methylbenzyl (MeBzl), 4-methoxybenzyl (MeOBzl), benzyloxy (BzlO), benzyl (Bzl), benzoyl (Bz), 3-nitro-2-pyridinesulphenyl (Npys), 1-(4,4-dimentyl-2,6-diaxocyclohexylidene)ethyl (Dde), 2,6-dichlorobenzyl (2,6-DiCl-Bzl), 2-chlorobenzyloxycarbonyl (2-Cl—Z), 2-bromobenzyloxycarbonyl (2-Br—Z), Benzyloxymethyl (Bom), cyclohexyloxy (cHxO), t-butoxymethyl (Bum), t-butoxy (tBuO), t-Butyl (tBu), Acetyl (Ac), and Trifluoroacetyl (TFA).

Protecting/blocking groups are well known to those of skill as are methods of coupling such groups to the appropriate residue(s) comprising the peptides of this invention (see, e.g., Greene et al., (1991) *Protective Groups in Organic Synthesis*, 2nd ed., John Wiley & Sons, Inc. Somerset, N.J.). In illustrative embodiment, for example, acetylation is accomplished during the synthesis when the peptide is on the resin using acetic anhydride. Amide protection can be achieved by the selection of a proper resin for the synthesis. For example, a rink amide resin can be used. After the completion of the synthesis, the semipermanent protecting groups on acidic bifunctional amino acids such as Asp and Glu and basic amino acid Lys, hydroxyl of Tyr are all simultaneously removed. The peptides released from such a resin using acidic treatment comes out with the n-terminal protected as acetyl and the carboxyl protected as $NH_2$ and with the simultaneous removal of all of the other protecting groups.

Where amino acid sequences are disclosed herein, amino acid sequences comprising, one or more protecting groups, e.g., as described above (or any other commercially available protecting groups for amino acids used, e.g., in boc or fmoc peptide synthesis) are also contemplated.

G) Peptide Circularization.

In certain embodiments the peptides described herein (e.g., AMPs, compound AMPs, STAMPs, etc.) are circularized/cyclized to produce cyclic peptides. Cyclic peptides, as contemplated herein, include head/tail, head/side chain, tail/side chain, and side chain/side chain cyclized peptides. In addition, peptides contemplated herein include homodet, containing only peptide bonds, and heterodet containing in addition disulfide, ester, thioester-bonds, or other bonds.

The cyclic peptides can be prepared using virtually any art-known technique for the preparation of cyclic peptides. For example, the peptides can be prepared in linear or non-cyclized form using conventional solution or solid phase peptide syntheses and cyclized using standard chemistries. Preferably, the chemistry used to cyclize the peptide will be sufficiently mild so as to avoid substantially degrading the peptide. Suitable procedures for synthesizing the peptides described herein as well as suitable chemistries for cyclizing the peptides are well known in the art.

In various embodiments cyclization can be achieved via direct coupling of the N- and C-terminus to form a peptide (or other) bond, but can also occur via the amino acid side chains. Furthermore it can be based on the use of other functional groups, including but not limited to amino, hydroxy, sulfhydryl, halogen, sulfonyl, carboxy, and thiocarboxy. These groups can be located at the amino acid side chains or be attached to their N- or C-terminus.

Accordingly, it is to be understood that the chemical linkage used to covalently cyclize the peptides of the invention need not be an amide linkage. In many instances it may be desirable to modify the N- and C-termini of the linear or non-cyclized peptide so as to provide, for example, reactive groups that may be cyclized under mild reaction conditions. Such linkages include, by way of example and not limitation amide, ester, thioester, $CH_2$—NH, etc. Techniques and reagents for synthesizing peptides having modified termini and chemistries suitable for cyclizing such modified peptides are well-known in the art.

Alternatively, in instances where the ends of the peptide are conformationally or otherwise constrained so as to make cyclization difficult, it may be desirable to attach linkers to the N- and/or C-termini to facilitate peptide cyclization. Of course, it will be appreciated that such linkers will bear reactive groups capable of forming covalent bonds with the termini of the peptide. Suitable linkers and chemistries are well-known in the art and include those previously described.

Cyclic peptides and depsipeptides (heterodetic peptides that include ester (depside) bonds as part of their backbone) have been well characterized and show a wide spectrum of biological activity. The reduction in conformational freedom brought about by cyclization often results in higher receptor-binding affinities. Frequently in these cyclic compounds, extra conformational restrictions are also built in, such as the use of D- and N-alkylated-amino acids, α,β-dehydro amino acids or α,α-disubstituted amino acid residues.

Methods of forming disulfide linkages in peptides are well known to those of skill in the art (see, e.g., Eichler and Houghten (1997) *Protein Pept. Lett.* 4: 157-164).

Reference may also be made to Marlowe (1993) *Biorg. Med. Chem. Lett.* 3: 437-44 who describes peptide cyclization on TFA resin using trimethylsilyl (TMSE) ester as an orthogonal protecting group; Pallin and Tam (1995) *J. Chem. Soc. Chem. Comm.* 2021-2022) who describe the cyclization of unprotected peptides in aqueous solution by oxime formation; Algin et al. (1994) *Tetrahedron Lett.* 35: 9633-9636 who disclose solid-phase synthesis of head-to-tail cyclic peptides via lysine side-chain anchoring; Kates et al. (1993) *Tetrahedron Lett.* 34: 1549-1552 who describe the production of head-to-tail cyclic peptides by three-dimensional solid phase strategy; Tumelty et al. (1994) *J. Chem. Soc. Chem. Comm.* 1067-1068, who describe the synthesis of cyclic peptides from an immobilized activated intermediate, where activation of the immobilized peptide is carried out with N-protecting group intact and subsequent removal leading to cyclization; McMurray et al. (1994) *Peptide Res.* 7: 195-206) who disclose head-to-tail cyclization of peptides attached to insoluble supports by means of the side chains of aspartic and glutamic acid; Hruby et al. (1994) *Reactive Polymers* 22: 231-241) who teach an alternate method for cyclizing peptides via solid supports; and Schmidt and Langer (1997) *J. Peptide Res.* 49: 67-73, who disclose a method for synthesizing cyclotetrapeptides and cyclopentapeptides.

These methods of peptide cyclization are illustrative and non-limiting. Using the teaching provide herein, other cyclization methods will be available to one of skill in the art.

H) Identification/Verification of Active Peptides

The active AMPs, STAMPs and the like can be identified and/or validated using an in vitro screening assay. Indeed, in many instances the AMPs and/or STAMPS described herein will be used in vitro as preservatives, topical antimicrobial treatments, and the like. Additionally, despite certain apparent limitations of in vitro susceptibility tests, clinical data indicate that a good correlation exists between minimal inhibitory concentration (MIC) test results and in vivo efficacy of antibiotic compounds (see, e.g., Murray et al. (1994) Antimicrobial Susceptibility Testing, Poupard et al., eds., Plenum Press, New York; Knudsen et al. (1995) *Antimicrob. Agents Chemother.* 39(6): 1253-1258; and the like). Thus, AMPs useful for treating infections and diseases related thereto are also conveniently identified by demonstrated in vitro antimicrobial activity against specified microbial targets, e.g., as illustrated in Table 4).

Typically, the in vitro antimicrobial activity of antimicrobial agents is tested using standard NCCLS bacterial inhibition assays, or MIC tests (see, National Committee on Clinical Laboratory Standards "Performance Standards for Antimicrobial Susceptibility Testing," NCCLS Document M100-S5 Vol. 14, No. 16, December 1994; "Methods for dilution antimicrobial susceptibility test for bacteria that grow aerobically-Third Edition," Approved Standard M7-A3, National Committee for Clinical Standards, Villanova, Pa.).

It will be appreciated that other assays as are well known in the art or that will become apparent to those having skill in the art upon review of this disclosure may also be used to identify active AMPs. Such assays include, for example, the assay described in Lehrer et al. (1988) *J. Immunol. Meth.*, 108: 153 and Steinberg and Lehrer, "Designer Assays for Antimicrobial Peptides: Disputing the 'One Size Fits All' Theory," In: Antibacterial Peptide Protocols, Shafer, Ed., Humana Press, N.J. Generally, active peptides of the invention will exhibit MICs (as measured using the assays described in the examples) of less than about 100 µM, preferably less than about 80 or 60 µM, more preferably about 50 µM or less, about 25 µM or less, or about 15 µM or less, or about 10 µM or less.

IV. Administration and Formulations.

A) Pharmaceutical Formulations.

In certain embodiments, the antimicrobial peptides and/or the chimeric constructs (e.g., targeting moieties attached to antimicrobial peptide(s), targeting moieties attached to detectable label(s), etc.) are administered to a mammal in need thereof, to a cell, to a tissue, to a composition (e.g., a food), etc.). In various embodiments the compositions can be administered to detect and/or locate, and/or quantify the presence of particular microorganisms, microorganism populations, biofilms comprising particular microorganisms, and the like. In various embodiments the compositions can be administered to inhibit particular microorganisms, microorganism populations, biofilms comprising particular microorganisms, and the like.

These active agents (antimicrobial peptides and/or chimeric moieties) can be administered in the "native" form or, if desired, in the form of salts, esters, amides, prodrugs, derivatives, and the like, provided the salt, ester, amide, prodrug or derivative is suitable pharmacologically, i.e., effective in the present method(s). Salts, esters, amides, prodrugs and other derivatives of the active agents can be prepared using standard procedures known to those skilled in the art of synthetic organic chemistry and described, for example, by March (1992) *Advanced Organic Chemistry; Reactions, Mechanisms and Structure*, 4th Ed. N.Y. Wiley-Interscience.

Methods of formulating such derivatives are known to those of skill in the art. For example, the disulfide salts of a number of delivery agents are described in PCT Publication WO 2000/059863 which is incorporated herein by reference. Similarly, acid salts of therapeutic peptides, peptoids, or other mimetics, and can be prepared from the free base using conventional methodology that typically involves reaction with a suitable acid. Generally, the base form of the drug is dissolved in a polar organic solvent such as methanol or ethanol and the acid is added thereto. The resulting salt either precipitates or can be brought out of solution by addition of a less polar solvent. Suitable acids for preparing acid addition salts include, but are not limited to both organic acids, e.g., acetic acid, propionic acid, glycolic acid, pyruvic acid, oxalic acid, malic acid, malonic acid, succinic acid, maleic acid, fumaric acid, tartaric acid, citric acid, benzoic acid, cinnamic acid, mandelic acid, methanesulfonic acid, ethanesulfonic acid, p-toluenesulfonic acid, salicylic acid, and the like, as well as inorganic acids, e.g., hydrochloric acid, hydrobromic acid, sulfuric acid, nitric acid, phosphoric acid, and the like. An acid addition salt can be reconverted to the free base by treatment with a suitable base. Certain particularly preferred acid addition salts of the active agents herein include halide salts, such as may be prepared using hydrochloric or hydrobromic acids. Conversely, preparation of basic salts of the active agents of this invention are prepared in a similar manner using a pharmaceutically acceptable base such as sodium hydroxide, potassium hydroxide, ammonium hydroxide, calcium hydroxide, trimethylamine, or the like. In certain embodiments basic salts include alkali metal salts, e.g., the sodium salt, and copper salts.

For the preparation of salt forms of basic drugs, the pKa of the counterion is preferably at least about 2 pH lower than the pKa of the drug. Similarly, for the preparation of salt forms of acidic drugs, the pKa of the counterion is preferably at least about 2 pH higher than the pKa of the drug. This permits the counterion to bring the solution's pH to a level lower than the pHmax to reach the salt plateau, at which the solubility of salt prevails over the solubility of free acid or base. The generalized rule of difference in pKa units of the ionizable group in the active pharmaceutical ingredient (API) and in the acid or base is meant to make the proton transfer energetically favorable. When the pKa of the API and counterion are not significantly different, a solid complex may form but may rapidly disproportionate (i.e., break down into the individual entities of drug and counterion) in an aqueous environment.

Preferably, the counterion is a pharmaceutically acceptable counterion. Suitable anionic salt forms include, but are not limited to acetate, benzoate, benzylate, bitartrate, bromide, carbonate, chloride, citrate, edetate, edisylate, estolate, fumarate, gluceptate, gluconate, hydrobromide, hydrochloride, iodide, lactate, lactobionate, malate, maleate, mandelate, mesylate, methyl bromide, methyl sulfate, mucate, napsylate, nitrate, pamoate (embonate), phosphate and diphosphate, salicylate and disalicylate, stearate, succinate, sulfate, tartrate, tosylate, triethiodide, valerate, and the like, while suitable cationic salt forms include, but are not limited to aluminum, benzathine, calcium, ethylene diamine, lysine, magnesium, meglumine, potassium, procaine, sodium, tromethamine, zinc, and the like.

In various embodiments preparation of esters typically involves functionalization of hydroxyl and/or carboxyl groups that are present within the molecular structure of the active agent. In certain embodiments, the esters are typically acyl-substituted derivatives of free alcohol groups, i.e., moieties that are derived from carboxylic acids of the formula RCOOH where R is alky, and preferably is lower alkyl. Esters can be reconverted to the free acids, if desired, by using conventional hydrogenolysis or hydrolysis procedures.

Amides can also be prepared using techniques known to those skilled in the art or described in the pertinent literature. For example, amides may be prepared from esters, using suitable amine reactants, or they may be prepared from an anhydride or an acid chloride by reaction with ammonia or a lower alkyl amine.

In various embodiments, the active agents identified herein are useful for parenteral, topical, oral, nasal (or otherwise inhaled), rectal, or local administration, such as by aerosol or transdermally, for detection and/or quantification, and or localization, and/or prophylactic and/or therapeutic treatment of infection (e.g., microbial infection). The compositions can be administered in a variety of unit dosage forms depending upon the method of administration. Suitable unit dosage forms, include, but are not limited to powders, tablets, pills, capsules, lozenges, suppositories, patches, nasal sprays, injectibles, implantable sustained-release formulations, lipid complexes, etc.

The active agents (e.g., antimicrobial peptides and/or chimeric constructs) described herein can also be combined with a pharmaceutically acceptable carrier (excipient) to form a pharmacological composition. In certain embodiments, pharmaceutically acceptable carriers include those approved by a regulatory agency of the Federal or a state government or listed in the U.S. Pharmacopeia or other generally recognized pharmacopeia for use in/on animals, and more particularly in/on humans. A "carrier" refers to, for example, a diluent, adjuvant, excipient, auxiliary agent or vehicle with which an active agent of the present invention is administered.

Pharmaceutically acceptable carriers can contain one or more physiologically acceptable compound(s) that act, for example, to stabilize the composition or to increase or decrease the absorption of the active agent(s). Physiologically acceptable compounds can include, for example, carbohydrates, such as glucose, sucrose, or dextrans, antioxidants, such as ascorbic acid or glutathione, chelating agents, low molecular weight proteins, protection and uptake enhancers such as lipids, compositions that reduce the clearance or hydrolysis of the active agents, or excipients or other stabilizers and/or buffers.

Other physiologically acceptable compounds, particularly of use in the preparation of tablets, capsules, gel caps, and the like include, but are not limited to binders, diluent/fillers, disentegrants, lubricants, suspending agents, and the like.

In certain embodiments, to manufacture an oral dosage form (e.g., a tablet), an excipient (e.g., lactose, sucrose, starch, mannitol, etc.), an optional disintegrator (e.g. calcium carbonate, carboxymethylcellulose calcium, sodium starch glycollate, crospovidone etc.), a binder (e.g. alpha-starch, gum arabic, microcrystalline cellulose, carboxymethylcellulose, polyvinylpyrrolidone, hydroxypropylcellulose, cyclodextrin, etc.), and an optional lubricant (e.g., talc, magnesium stearate, polyethylene glycol 6000, etc.), for instance, are added to the active component or components (e.g., active peptide) and the resulting composition is compressed. Where necessary the compressed product is coated, e.g., known methods for masking the taste or for enteric dissolution or sustained release. Suitable coating materials include, but are not limited to ethyl-cellulose, hydroxymethylcellulose, polyoxyethylene glycol, cellulose acetate phthalate, hydroxypropylmethylcellulose phthalate, and Eudragit (Rohm & Haas, Germany; methacrylic-acrylic copolymer).

Other physiologically acceptable compounds include wetting agents, emulsifying agents, dispersing agents or preservatives that are particularly useful for preventing the growth or action of microorganisms. Various preservatives are well known and include, for example, phenol and ascorbic acid. One skilled in the art would appreciate that the choice of pharmaceutically acceptable carrier(s), including a physiologically acceptable compound depends, for example, on the route of administration of the active agent(s) and on the particular physio-chemical characteristics of the active agent(s).

In certain embodiments the excipients are sterile and generally free of undesirable matter. These compositions can be sterilized by conventional, well-known sterilization techniques. For various oral dosage form excipients such as tablets and capsules sterility is not required. The USP/NF standard is usually sufficient.

In certain therapeutic applications, the compositions of this invention are administered, e.g., topically administered or administered to the oral or nasal cavity, to a patient suffering from infection or at risk for infection or prophylactically to prevent dental caries or other pathologies of the teeth or oral mucosa characterized by microbial infection in an amount sufficient to prevent and/or cure and/or at least partially prevent or arrest the disease and/or its complications. An amount adequate to accomplish this is defined as a "therapeutically effective dose." Amounts effective for this use will depend upon the severity of the disease and the general state of the patient's health. Single or multiple administrations of the compositions may be administered depending on the dosage and frequency as required and tolerated by the patient. In any event, the composition should provide a sufficient quantity of the active agents of the formulations of this invention to effectively treat (ameliorate one or more symptoms in) the patient.

The concentration of active agent(s) can vary widely, and will be selected primarily based on activity of the active ingredient(s), body weight and the like in accordance with the particular mode of administration selected and the patient's needs. Concentrations, however, will typically be selected to provide dosages ranging from about 0.1 or 1 mg/kg/day to about 50 mg/kg/day and sometimes higher. Typical dosages range from about 3 mg/kg/day to about 3.5 mg/kg/day, preferably from about 3.5 mg/kg/day to about 7.2 mg/kg/day, more preferably from about 7.2 mg/kg/day to about 11.0 mg/kg/day, and most preferably from about 11.0 mg/kg/day to about 15.0 mg/kg/day. In certain preferred embodiments, dosages range from about 10 mg/kg/day to about 50 mg/kg/day. In certain embodiments, dosages range from about 20 mg to about 50 mg given orally twice daily. It will be appreciated that such dosages may be varied to optimize a therapeutic and/or phophylactic regimen in a particular subject or group of subjects.

In certain embodiments, the active agents of this invention are administered to the oral cavity. This is readily accomplished by the use of lozenges, aersol sprays, mouthwash, coated swabs, and the like.

In certain embodiments, the active agent(s) of this invention are administered topically, e.g., to the skin surface, to a topical lesion or wound, to a surgical site, and the like.

In certain embodiments the active agents of this invention are administered systemically (e.g., orally, or as an injectable) in accordance with standard methods well known to those of skill in the art. In other preferred embodiments, the agents, can also be delivered through the skin using conventional transdermal drug delivery systems, i.e., transdermal "patches" wherein the active agent(s) are typically contained within a laminated structure that serves as a drug delivery device to be affixed to the skin. In such a structure, the drug composition is typically contained in a layer, or "reservoir," underlying an upper backing layer. It will be appreciated that the term "reservoir" in this context refers to a quantity of "active ingredient(s)" that is ultimately available for delivery to the surface of the skin. Thus, for example, the "reservoir" may include the active ingredient(s) in an adhesive on a backing layer of the patch, or in any of a variety of different matrix formulations known to those of skill in the art. The patch may contain a single reservoir, or it may contain multiple reservoirs.

In one embodiment, the reservoir comprises a polymeric matrix of a pharmaceutically acceptable contact adhesive material that serves to affix the system to the skin during drug delivery. Examples of suitable skin contact adhesive materials include, but are not limited to, polyethylenes, polysiloxanes, polyisobutylenes, polyacrylates, polyurethanes, and the like. Alternatively, the drug-containing reservoir and skin contact adhesive are present as separate and distinct layers, with the adhesive underlying the reservoir which, in this case, may be either a polymeric matrix as described above, or it may be a liquid or hydrogel reservoir, or may take some other form. The backing layer in these laminates, which serves as the upper surface of the device, preferably functions as a primary structural element of the "patch" and provides the device with much of its flexibility. The material selected for the backing layer is preferably substantially impermeable to the active agent(s) and any other materials that are present.

Other formulations for topical delivery include, but are not limited to, ointments, gels, sprays, fluids, and creams. Ointments are semisolid preparations that are typically based on petrolatum or other petroleum derivatives. Creams containing the selected active agent are typically viscous liquid or semisolid emulsions, often either oil-in-water or water-in-oil. Cream bases are typically water-washable, and contain an oil phase, an emulsifier and an aqueous phase. The oil phase, also sometimes called the "internal" phase, is generally comprised of petrolatum and a fatty alcohol such as cetyl or stearyl alcohol; the aqueous phase usually, although not necessarily, exceeds the oil phase in volume, and generally contains a humectant. The emulsifier in a cream formulation is generally a nonionic, anionic, cationic or amphoteric surfactant. The specific ointment or cream base to be used, as will be appreciated by those skilled in the art, is one that will provide for optimum drug delivery. As with other carriers or vehicles, an ointment base should be inert, stable, nonirritating and nonsensitizing.

As indicated above, various buccal, and sublingual formulations are also contemplated.

In certain embodiments, one or more active agents of the present invention can be provided as a "concentrate", e.g., in a storage container (e.g., in a premeasured volume) ready for dilution, or in a soluble capsule ready for addition to a volume of water, alcohol, hydrogen peroxide, or other diluent.

While the invention is described with respect to use in humans, it is also suitable for animal, e.g., veterinary use. Thus certain preferred organisms include, but are not limited to humans, non-human primates, canines, equines, felines, porcines, ungulates, largomorphs, and the like.

B) Nanoemulsion Formulations.

In certain embodiments the targeting peptides, antimicrobial peptides and/or chimeric moieties (e.g., STAMPs) as described herein are formulated in a nanoemulsion. Nanoemulsions include, but are not limited to oil in water (O/W) nanoemulsions, and water in oil (W/O) nanoemulsions. Nanoemulsions can be defined as emulsions with mean droplet diameters ranging from about 20 to about 1000 nm. Usually, the average droplet size is between about 20 nm or 50 nm and about 500 nm. The terms sub-micron emulsion (SME) and mini-emulsion are used as synonyms.

Illustrative oil in water (O/W) nanoemulsions include, but are not limited to:

Surfactant micelles—micelles composed of small molecules surfactants or detergents (e.g., SDS/PBS/2-propanol) which are suitable for predominantly hydrophobic peptides.

Polymer micelles—micelles composed of polymer, copolymer, or block copolymer surfactants (e.g., Pluronic L64/PBS/2-propanol) which are suitable for predominantly hydrophobic peptides;

Blended micelles: micelles in which there is more than one surfactant component or in which one of the liquid phases (generally an alcohol or fatty acid compound) participates in the formation of the micelle (e.g., Octanoic acid/PBS/EtOH) which are suitable for predominantly hydrophobic peptides;

Integral peptide micelles—blended micelles in which the peptide serves as an auxiliary surfactant, forming an integral part of the micelle (e.g., amphipathic peptide/PBS/mineral oil) which are suitable for amphipathic peptides; and Pickering (solid phase) emulsions—emulsions in which the peptides are associated with the exterior of a solid nanoparticle (e.g., polystyrene nanoparticles/PBS/no oil phase) which are suitable for amphipathic peptides.

Illustrative water in oil (W/O) nanoemulsions include, but are not limited to:

Surfactant micelles—micelles composed of small molecules surfactants or detergents (e.g., dioctyl sulfosuccinate/PBS/2-propanol, Isopropylmyristate/PBS/2-propanol, etc.) which are suitable for predominantly hydrophilic peptides;

Polymer micelles—micelles composed of polymer, copolymer, or block copolymer surfactants (e.g., PLURONIC® L121/PBS/2-propanol), which are suitable for predominantly hydrophilic peptides;

Blended micelles—micelles in which there is more than one surfactant component or in which one of the liquid phases (generally an alcohol or fatty acid compound) participates in the formation of the micelle (e.g., capric/caprylic diglyceride/PBS/EtOH) which are suitable for predominantly hydrophilic peptides;

Integral peptide micelles—blended micelles in which the peptide serves as an auxiliary surfactant, forming an integral part of the micelle (e.g., amphipathic peptide/PBS/polypropylene glycol) which are suitable for amphipathic peptides; and Pickering (solid phase) emulsions—emulsions in which the peptides are associated with the exterior of a solid nanoparticle (e.g., chitosan nanoparticles/no aqueous phase/mineral oil) which are suitable for amphipathic peptides.

As indicated above, in certain embodiments the nanoemulsions comprise one or more surfactants or detergents. In some embodiments the surfactant is a non-anionic detergent (e.g., a polysorbate surfactant, a polyoxyethylene ether, etc.). Surfactants that find use in the present invention include, but are not limited to surfactants such as the TWEEN®, TRITON®, and TYLOXAPOL® families of compounds.

In certain embodiments the emulsions further comprise one or more cationic halogen containing compounds, including but not limited to, cetylpyridinium chloride. In still further embodiments, the compositions further comprise one or more compounds that increase the interaction ("interaction enhancers") of the composition with microorganisms (e.g., chelating agents like ethylenediaminetetraacetic acid, or ethylenebis (oxyethylenenitrilo)tetraacetic acid in a buffer).

In some embodiments, the nanoemulsion further comprises an emulsifying agent to aid in the formation of the emulsion. Emulsifying agents include compounds that aggregate at the oil/water interface to form a kind of continuous membrane that prevents direct contact between two adjacent droplets. Certain embodiments of the present invention feature oil-in-water emulsion compositions that may readily be diluted with water to a desired concentration without impairing their anti-pathogenic properties.

In addition to discrete oil droplets dispersed in an aqueous phase, certain oil-in-water emulsions can also contain other lipid structures, such as small lipid vesicles (e.g., lipid spheres that often consist of several substantially concentric lipid bilayers separated from each other by layers of aqueous phase), micelles (e.g., amphiphilic molecules in small clusters of 50-200 molecules arranged so that the polar head groups face outward toward the aqueous phase and the apolar tails are sequestered inward away from the aqueous phase), or lamellar phases (lipid dispersions in which each particle consists of parallel amphiphilic bilayers separated by thin films of water).

These lipid structures are formed as a result of hydrophobic forces that drive apolar residues (e.g., long hydrocarbon chains) away from water. The above lipid preparations can generally be described as surfactant lipid preparations (SLPs). SLPs are minimally toxic to mucous membranes and are believed to be metabolized within the small intestine (see e.g., Hamouda et al., (1998) *J. Infect. Disease* 180: 1939).

In certain embodiments the emulsion comprises a discontinuous oil phase distributed in an aqueous phase, a first component comprising an alcohol and/or glycerol, and a second component comprising a surfactant or a halogen-containing compound. The aqueous phase can comprise any type of aqueous phase including, but not limited to, water (e.g., dionized water, distilled water, tap water) and solutions (e.g., phosphate buffered saline solution, or other buffer systems). The oil phase can comprise any type of oil including, but not limited to, plant oils (e.g., soybean oil, avocado oil, flaxseed oil, coconut oil, cottonseed oil, squalene oil, olive oil, canola oil, corn oil, rapeseed oil, safflower oil, and sunflower oil), animal oils (e.g., fish oil), flavor oil, water insoluble vitamins, mineral oil, and motor oil. In certain embodiments, the oil phase comprises 30-90 vol % of the oil-in-water emulsion (i.e., constitutes 30-90% of the total volume of the final emulsion), more preferably 50-80%.

In certain embodiments the alcohol, when present, is ethanol.

While the present invention is not limited by the nature of the surfactant, in some preferred embodiments, the surfactant is a polysorbate surfactant (e.g., TWEEN 20®, TWEEN 40®, TWEEN 60®, and TWEEN 80®), a pheoxypolyethoxyethanol (e.g., TRITON® X-100, X-301, X-165, X-102, and X-200, and TYLOXAPOL®), or sodium dodecyl sulfate, and the like.

In certain embodiments a halogen-containing component is present. the nature of the halogen-containing compound, in some preferred embodiments the halogen-containing compound comprises a chloride salt (e.g., NaCl, KCl, etc.), a cetylpyridinium halide, a cetyltrimethylammonium halide, a cetyldimethylethylammonium halide, a cetyldimethylbenzylammonium halide, a cetyltributylphosphonium halide, dodecyltrimethylammonium halides, tetradecyltrimethylammonium halides, cetylpyridinium chloride, cetyltrimethylammonium chloride, cetylbenzyldimethylammonium chloride, cetylpyridinium bromide, cetyltrimethylammonium bromide, cetyldimethylethylammonium bromide, cetyltributylphosphonium bromide, dodecyltrimethylammonium bromide, tetradecyltrimethylammonium bromide, and the like In certain embodiments the emulsion comprises a quaternary ammonium compound. Quaternary ammonium compounds include, but are not limited to, N-alkyldimethyl benzyl ammonium saccharinate, 1,3,5-Triazine-1,3,5(2H,4H,6H)-triethanol; 1-Decanaminium, N-decyl-N,N-dimethyl-, chloride (or) Didecyl dimethyl ammonium chloride; 2-(2-(p-(Diisobuyl)cresosxy)ethoxy)ethyl dimethyl benzyl ammonium chloride; 2-(2-(p-(Diisobutyl)phenoxy)ethoxy)ethyl dimethyl benzyl ammonium chloride; alkyl 1 or 3-benzyl-1-(2-hydroxethyl)-2-imidazolinium chloride; alkyl bis(2-hydroxyethyl)benzyl ammonium chloride; alkyl demethyl benzyl ammonium chloride; alkyl dimethyl 3,4-dichlorobenzyl ammonium chloride (100% C12); alkyl dimethyl 3,4-dichlorobenzyl ammonium chloride (50% C14, 40% C12, 10% C16); alkyl dimethyl 3,4-dichlorobenzyl ammonium chloride (55% C14, 23% C12, 20% C16); alkyl dimethyl benzyl ammonium chloride; alkyl dimethyl benzyl ammonium chloride (100% C14); alkyl dimethyl benzyl ammonium chloride (100% C16); alkyl dimethyl benzyl ammonium chloride (41% C14, 28% C12); alkyl dimethyl benzyl ammonium chloride (47% C12, 18% C14); alkyl dimethyl benzyl ammonium chloride (55% C16, 20% C14); alkyl dimethyl benzyl ammonium chloride (58% C14, 28% C16); alkyl dimethyl benzyl ammonium chloride (60% C14, 25% C12); alkyl dimethyl benzyl ammonium chloride (61% C11, 23% C14); alkyl dimethyl benzyl ammonium chloride (61% C12, 23% C14); alkyl dimethyl benzyl ammonium chloride (65% C12, 25% C14); alkyl dimethyl benzyl ammonium chloride (67% C12, 24% C14); alkyl dimethyl benzyl ammonium chloride (67% C12, 25% C14); alkyl dimethyl benzyl ammonium chloride (90% C14, 5% C12); alkyl dimethyl benzyl ammonium chloride (93% C14, 4% C12); alkyl dimethyl benzyl ammonium chloride (95% C16, 5% C18); alkyl dimethyl benzyl ammonium chloride (and) didecyl dimethyl ammonium chloride; alkyl dimethyl benzyl ammonium chloride (as in fatty acids); alkyl dimethyl benzyl ammonium chloride (C12-C16); alkyl dimethyl benzyl ammonium chloride (C12-C18); alkyl dimethyl benzyl and dialkyl dimethyl ammonium chloride; alkyl dimethyl dimethybenzyl ammonium chloride; alkyl dimethyl ethyl ammonium bromide (90% C14, 5% C16, 5% C12); alkyl dimethyl ethyl ammonium bromide (mixed alkyl and alkenyl groups as in the fatty acids of soybean oil); alkyl dimethyl ethylbenzyl ammonium chloride; alkyl dimethyl ethylbenzyl ammonium chloride (60% C14); alkyl dimethyl isoproylbenzyl ammonium chloride (50% C12, 30% C14, 17% C16, 3% C18); alkyl trimethyl ammonium chloride (58% C18, 40% C16, 1% C14, 1% C12); alkyl trimethyl ammonium chloride (90% C18, 10% C16); alkyldimethyl (ethylbenzyl) ammonium chloride (C12-18); Di-(C8-10)-alkyl dimethyl ammonium chlorides; dialkyl dimethyl ammonium chloride; dialkyl dimethyl ammonium chloride; dialkyl dimethyl ammonium chloride; dialkyl methyl benzyl ammonium chloride; didecyl dimethyl ammonium chloride; diisodecyl dimethyl ammonium chloride; dioctyl dimethyl ammonium chloride; dodecyl bis(2-hydroxyethyl) octyl hydrogen ammonium chloride; dodecyl dimethyl benzyl ammonium chloride; dodecylcarbamoyl methyl dimethyl benzyl ammonium chloride; heptadecyl hydroxyethylimidazolinium chloride; hexahydro-1,3,5-thris(2-hydroxyethyl)-s-triazine; myristalkonium chloride (and) Quat RNIUM 14;

N,N-Dimethyl-2-hydroxypropylammonium chloride polymer; n-alkyl dimethyl benzyl ammonium chloride; n-alkyl dimethyl ethylbenzyl ammonium chloride; n-tetradecyl dimethyl benzyl ammonium chloride monohydrate; octyl decyl dimethyl ammonium chloride; octyl dodecyl dimethyl ammonium chloride; octyphenoxyethoxyethyl dimethyl benzyl ammonium chloride; oxydiethylenebis (alkyl dimethyl ammonium chloride); quaternary ammonium compounds, dicoco alkyldimethyl, chloride; trimethoxysily propyl dimethyl octadecyl ammonium chloride; trimethoxysilyl quats, trimethyl dodecylbenzyl ammonium chloride; n-dodecyl dimethyl ethylbenzyl ammonium chloride; n-hexadecyl dimethyl benzyl ammonium chloride; n-tetradecyl dimethyl benzyl ammonium chloride; n-tetradecyl dimethyl ethylbenzyl ammonium chloride; and n-octadecyl dimethyl benzyl ammonium chloride.

Nanoemulsion formulations and methods of making such are well known to those of skill in the art and described for example in U.S. Pat. Nos. 7,476,393, 7,468,402, 7,314,624, 6,998,426, 6,902,737, 6,689,371, 6,541,018, 6,464,990, 6,461,625, 6,419,946, 6,413,527, 6,375,960, 6,335,022, 6,274,150, 6,120,778, 6,039,936, 5,925,341, 5,753,241, 5,698,219, and 5,152,923 and in Fanun et al. (2009) Microemulsions: Properties and Applications (Surfactant Science), CRC Press, Boca Ratan Fl.

C) Formulations Optimizing Activity.

In certain embodiments, formulations are selected to optimize binding specificity, and/or binding avidity, and/or antimicrobial activity, and/or stability/conformation of the targeting peptide, antimicrobial peptide, chimeric moiety, and/or STAMP. In this regard, it was a surprising discovery that the activity of certain STAMPs, and presumably the constituent targeting peptides and/or antimicrobial peptides was optimized in the presence of a salt. Accordingly, certain embodiments are contemplated where the targeting peptide and/or antimicrobial peptide, and/or STAMP is formulated in combination with one or more salts. The formulatiosn disclosed herein, however, are not limited to those containing salt(s). Embodiments, are also contemplated where the targeting peptide and/or antimicrobial peptide, and/or STAMP is formulated without the presence of a salt.

In certain embodiments, sodium chloride plus a little potassium chloride resulted in the best activity of the salts tested. However, other salts, e.g., $CaCl_2$, $MgCl_2$, $MnCl_2$ also enhanced activity. Accordingly, in certain embodiments, it is contemplated that the targeting peptide(s), and/or antimicrobial peptide(s), and/or chimeric moieties, and/or STAMPs are formulated with one or more salts.

In certain embodiments suitable salts include any of a number of pharmaceutically acceptable salts. Representative salts include the hydrobromide, hydrochloride, sulfate, bisulfate, phosphate, nitrate, acetate, valerate, oleate, palmitate, stearate, laurate, benzoate, lactate, phosphate, tosylate, citrate, maleate, fumarate, succinate, tartrate, napthylate, mesylate, besylate, glucoheptonate, lactobionate, and laurylsulphonate salts and the like (see, e.g., Berge et al. (1977) *J. Pharm. Sci.* 66: 1-19), although it is noted that citrate salts appear to inhibit the activity of certain STAMPs.

In certain embodiments pharmaceutically acceptable salts of the present invention include the conventional nontoxic salts or quaternary ammonium salts of the compounds, e.g., from non-toxic organic or inorganic acids. For example, such conventional nontoxic salts include those derived from inorganic acids such as hydrochloride, hydrobromic, sulfuric, sulfamic, phosphoric, nitric, and the like; and the salts prepared from organic acids such as acetic, propionic, succinic, glycolic, stearic, lactic, malic, tartaric, citric, ascorbic, palmitic, maleic, hydroxymaleic, phenylacetic, glutamic, benzoic, salicyclic, sulfanilic, 2-acetoxybenzoic, fumaric, toluenesulfonic, methanesulfonic, benzenesulfonic, ethane disulfonic, oxalic, isothionic, and the like.

In other cases, the compounds of the present invention may contain one or more acidic functional groups and, thus, are capable of forming pharmaceutically-acceptable salts with pharmaceutically-acceptable bases. The term "pharmaceutically-acceptable salts" in these instances refers to the relatively non-toxic, inorganic and organic base addition salts of compounds of the present invention. These salts can likewise be prepared in situ in the administration vehicle or the dosage form manufacturing process, or by separately treating the compound in its free acid form with a suitable base, such as the hydroxide, carbonate or bicarbonate of a pharmaceutically-acceptable metal cation, with ammonia, or with a pharmaceutically-acceptable organic primary, secondary or tertiary amine. Representative alkali or alkaline earth salts include the lithium, sodium, potassium, calcium, magnesium, and aluminum salts and the like. Representative organic amines useful for the formation of base addition salts include ethylamine, diethylamine, ethylenediamine, ethanolamine, diethanolamine, piperazine and the like (see, for example, Berge et al., supra; and Stahl and Wermuth (2002) Handbook of Pharmaceutical Salts: Properties, Selection, and Use, Wiley-VCH, Zurich, Switzerland).

In various embodiments, the salt is simply a sodium chloride and/or a potassium chloride and can readily be prepared, for example, as a phosphate buffered saline (PBS) solution. In certain embodiments, the salt concentration is comparable to that found in 0.5×PBS to about 2.5×PBS, more preferably from about 0.5×PBS to about 1.5×PBS. In certain embodiments optimum activity has been observed in 1×PBS.

In various embodiments, the pH of the formulation ranges from about pH 5.0 to about pH 8.5, preferably from about pH 6.0 to about pH 8.0, more preferably from about pH 7.0 to about pH 8.0. In certain embodiments the pH is about pH 7.4.

While optimum results have been observed for certain STAMPs using a PBS buffer system, other buffer systems are also acceptable. Such buffers include, but are not limited to sulfate buffers, carbonate buffers, Tris buffers, CHAPS buffers, PIPES buffers, and the like, as long as the salt is included.

In various embodiments, the targeting peptide, and/or antimicrobial peptide, and/or chimeric moiety, and/or STAMP is present in the formulation at a concentration ranging from about 1 nM, to about 1, 10, or 100 mM, more preferably from about 1 nM, about 10 nM, about 100 nM, about 1 μM, or about 10 μM to about 50 μM, about 100 μM, about 200 μm, about 300 μM, about 400 μM, or about 500 μM, preferably from about 1 μM, about 10 μM, about 25 μM, or about 50 μM to about 1 mM, about 10 mM, about 20 mM, or about 5 mM, most preferably from about 10 μM, about 20 μM, or about 50 μM to about 100 μM, about 150 μM, or about 200 μM.

D) Home Health Care/Hygiene Product Formulations.

In certain embodiments, one or more of the targeting peptide(s), and/or antimicrobial peptides (AMPs) and/or chimeric moieties, and/or STAMPS described herein are incorporated into healthcare formulations, e.g., for home use. Such formulations include, but are not limited to toothpaste, mouthwash, tooth whitening strips or solutions, contact lens storage, wetting, or cleaning solutions, dental floss, toothpicks, toothbrush bristles, oral sprays, oral lozenges, nasal sprays, aerosolizers for oral and/or nasal application, wound dressings (e.g., bandages), and the like.

For example, chimeric moieties and/or STAMPs, and/or AMPs directed against *S. mutans* are well suited for inhibiting frequency or severity of dental caries formation, plaque formation, periodontal disease, and/or halitosis.

Chimeric moieties and/or STAMPs, and/or AMPs directed against *Corynebacterium* spp, when applied to a skin surface can reduce/eliminate *Corynebacterium* resulting in a reduction of odors. Such moieties are readily incorporated in soaps, antibiotics, antiseptics, disinfectants, and the like.

The formulation of such health products is well known to those of skill, and the antimicrobial peptides and/or chimeric constructs are simply added to such formulations in an effective dose (e.g., a prophylactic dose to inhibit dental carie formation, etc.).

For example, toothpaste formulations are well known to those of skill in the art. Typically such formulations are mixtures of abrasives and surfactants; anticaries agents, such as fluoride; tartar control ingredients, such as tetrasodium pyrophosphate and methyl vinyl ether/maleic anhydride copolymer; pH buffers; humectants, to prevent dry-out and increase the pleasant mouth feel; and binders, to provide consistency and shape (see, e.g., Table 17). Binders keep the solid phase properly suspended in the liquid phase to prevent separation of the liquid phase out of the toothpaste. They also provide body to the dentifrice, especially after extrusion from the tube onto the toothbrush.

TABLE 17

Typical components of toothpaste.

| Ingredients | Wt % |
| --- | --- |
| Humectants | 40-70 |
| Water | 0-50 |
| Buffers/salts/tartar control | 0.5-10 |
| Organic thickeners (gums) | 0.4-2 |
| Inorganic thickeners | 0-12 |
| Abrasives | 10-50 |
| Actives (e.g., triclosan) | 0.2-1.5 |
| Surfactants | 0.5-2 |
| Flavor and sweetener | 0.8-1.5 |

Fluoride sources provide 1000-15000 ppm fluorine.

Table 18 lists typical ingredients used in formulations; the final combination will depend on factors such as ingredient compatibility and cost, local customs, and desired benefits and quality to be delivered in the product. It will be recognized that one or more antimicrobial peptides and/or chimeric constructs described herein can simply be added to such formulations or used in place of one or more of the other ingredients.

TABLE 18

List of typical ingredients.

| Gums | Inorganic Thickeners | Abrasives | Surfactants | Humectants | Tartar Control Ingredient |
| --- | --- | --- | --- | --- | --- |
| Sodium carboxymethyl cellulose | Silica thickeners | Hydrated silica | Sodium lauryl sulfate | Glycerine | Tetrasodium pyrophosphate |
| Cellulose ethers | Sodium aluminum silicates | Dicalcium phosphate digydrate | Sodium N-lauryl sarcosinate | Sorbitol | Gantrez S-70 |
| Xanthan Gum | Clays | Calcium carbonate | Pluronics | Propylene glycol | Sodium tri-polyphosphate |
| Carrageenans | | Sodium bicarbonate | | Xylitol | |
| Sodium alginate | | Calcium pyrophosphate | Sodium lauryl sulfoacetate | Polyethylene glycol | |
| Carbopols | | Alumina | | | |

One illustrative formulation described in U.S. Pat. No. 6,113,887 comprises (1) a water-soluble bactericide selected from the group consisting of pyridinium compounds, quaternary ammonium compounds and biguanide compounds in an amount of 0.001% to 5.0% by weight, based on the total weight of the composition; (2) a cationically-modified hydroxyethylcellulose having an average molecular weight of 1,000,000 or higher in the hydroxyethylcellulose portion thereof and having a cationization degree of 0.05 to 0.5 mol/glucose in an amount of 0.5% to 5.0% by weight, based on the total weight of the composition; (3) a surfactant selected from the group consisting of polyoxyethylene polyoxypropylene block copolymers and alkylolamide compounds in an amount of 0.5% to 13% by weight, based on the total weight of the composition; and (4) a polishing agent of the non-silica type in an amount of 5% to 50% by weight, based on the total weight of the composition. In certain embodiments, the antimicrobial peptide(s) and/or chimeric construct(s) described herein can be used in place of the bactericide or in combination with the bactericide.

Similarly, mouthwash formulations are also well known to those of skill in the art. Thus, for example, mouthwashes containing sodium fluoride are disclosed in U.S. Pat. Nos. 2,913,373, 3,975,514, and 4,548,809, and in US Patent Publications US 2003/0124068 A1, US 2007/0154410 A1, and the like. Mouthwashes containing various alkali metal compounds are also known: sodium benzoate (WO 9409752); alkali metal hypohalite (US 20020114851A1); chlorine dioxide (CN 1222345); alkali metal phosphate (US 2001/0002252 A1, US 2003/0007937 A1); hydrogen sulfate/carbonate (JP 8113519); cetylpyridium chloride (CPC) (see, e.g., U.S. Pat. No. 6,117,417, U.S. Pat. No. 5,948,390, and JP 2004051511). Mouthwashes containing higher alcohol (see, e.g., US 2002/0064505 A1, US 2003/0175216 A1); hydrogen peroxide (see, e.g., CN 1385145); $CO_2$ gas bubbles (see, e.g., JP 1275521 and JP 2157215) are also known. In certain embodiments, these and other mouthwash formulations can further comprise one or more of the AMPs or compound AMPs of this invention.

Contact lens storage, wetting, or cleaning solutions, dental floss, toothpicks, toothbrush bristles, oral sprays, oral lozenges, nasal sprays, and aerosolizers for oral and/or nasal application, and the like are also well known to those of skill in the art and can readily be adapted to incorporate one or more antimicrobial peptide(s) and/or chimeric construct(s) described herein.

The foregoing pharmaceutical and/or home healthcare formulations and/or devices are meant to be illustrative and not limiting. Using teaching provided herein, the antimicrobial peptide(s) and/or chimeric construct(s) described herein can readily be incorporated into other products.

E) Illustrative Oral Care Formulations.

The targeting peptide(s), and/or antimicrobial peptide(s), and/or chimeric moieties, and/or STAMPs described herein can be used for a number of applications, e.g., as described above. In certain embodiments anti-S. mutans STAMPs, AMPs, and/or other chimeric moieties can be used to reduce the incidence or severity of dental caries, inhibit plaque formation, reduce halitosis, and the like. Accordingly, in certain embodiments, such moieties are included in devices and formulations for dental applications e.g., tea or other drinks, toothpick coatings, dental floss coatings, toothpaste, gel, mouthwash, varnish, even professional dental products.

In certain embodiments, methods of treating or reducing the incidence, duration, or severity of periodontal disease are provided. The methods can include applying to the gingival crevice or periodontal pocket a composition comprising a targeting peptide, and/or antimicrobial peptide, and/or STAMP, and/or other chimeric moiety as described herein with a carrier/stabilizing agent. In the composition applied, the carrier/stabilizing agent can provide retention, tissue penetration, deposition and sustained release of the active agent (e.g., STAMP) for reducing the population of specific bacterial species within a periodontal biofilm and associated tissues. In certain embodiments, the carrier agent provides penetration and retention into the gingival crevice or periodontal pocket and associated tissues with sustained release of the active agent to enhance the reduction in population of select bacteria within the gingival tissue and dentinal tubule tissue.

In various embodiments, carrier agents can include, but are not limited to polylactide, polyglycolide, polylactide-co-glycolide, polycaprolactone, cellulosic-based polymers, ethylene glycol polymers and its copolymers, oxyethylene polymers, polyvinyl alcohol, chitosan and hyaluronan and its copolymers. In an aspect, the carrier agents include hydroxyethyl cellulose, hydroxypropyl cellulose, hydroxypropylmethyl cellulose, hydroxymethyl cellulose, polyvinyl alcohol, polyethylene glycol, polyethylene oxide, ethylene oxide-propylene oxide co-polymers, chitosan, hyaluronan and its copolymers, or combinations thereof. In another aspect, the carrier agents include hyaluronan or hyaluronic acid and copolymers including salts of hyaluronic acid, esters of hyaluronic acid, cross-linked gels of hyaluronic acid, enzymatic derivatives of hyaluronic acid, chemically modified derivatives of hyaluronic acid or combinations thereof. As used herein, hyaluronic acid broadly refers to naturally occurring, microbial and synthetic derivatives of acidic polysaccharides of various molecular weights constituted by residues of D-glucuronic acid polysaccharides and N-acetyl-D-glucosamine.

In certain embodiments, the active agent (e.g., STAMP, AMP, etc.) and the carrier agent are in the form of an admixture, in the form of a complex, covalently coupled, or a combination thereof. In certain embodiments, the carrier agent comprises a bioadhesive. Suitable bioadhesive carrier agents include, but are not limited to a cellulose based polymer and/or a dextrin. Suitable cellulose based polymers include, but are not limited to hydroxyethyl cellulose, hydroxypropyl cellulose, hydroxymethyl cellulose, or a mixture thereof. In one illustrative embodiment, the bioadhesive carrier agent includes polylactide, polyglycolide, polylactide-co-glycolide, polyethylene glycol, hyaluronan, hyaluronic acid, chitosan, or a mixture thereof. In certain embodiments the bioadhesive carrier agent can include a copolymer comprising polyethylene glycol, hyaluronan, hyaluronic acid, chitosan, or a mixture thereof.

In certain embodiments, the carrier agent penetrates periodontal tissues. Suitable penetrating carrier agents include, but are not limited to hyaluronic acid, a hyaluronic acid derivative, chitosan, a chitosan derivative, or a mixture thereof. In an embodiment, the penetrating carrier agent includes a salt of hyaluronic acid, an ester of hyaluronic acid, an enzymatic derivative of hyaluronic acid, a cross-linked gel of hyaluronic acid, a chemically modified derivative of hyaluronic acid, or a mixture thereof.

V. Microorganism Detection.

As indicated above, the targeting moieties and/or STAMPs are useful in diagnostic compositions and methods to determine the presence or absence and/or to quantify the amount of one or microorganisms present in the environment, in a food stuff, in a biological sample, and the like.

For example, targeting peptide-antimicrobial peptide conjugates (e.g. Specifically targeted antimicrobial peptides (STAMPs)) can be used as diagnostic reagents. STAMPs (and other targeted antimicrobial constructs described herein) have the ability to specifically bind to microorganisms, for example, S. mutans, and permeabilize or disrupt their membrane such that cell impermeable dyes or other reagent (propidium iodide, etc.) may enter the microorganism or intracellular molecules or contents (ATP, DNA, Calcium, etc.) of the targeted microorganism are caused to be released into the environment for analysis. In one method a STAMP, for example, C16G2, can permeabilize or disrupt the membrane of target microorganisms, for example, S. mutans, in a prepared culture or clinical sample by itself, in a biofilm in vitro or in vivo. To the sample a cell impermeable dye (e.g. propidium iodide, etc.) is added to label and allow for detection of those microorganisms targeted by the STAMP. Cell permeable dyes (e.g. SYTO9) can also be added to label and detect the entire population of microorganisms in the sample. Labeled cells can then be quantified by fluorescence microscopy, fluorometry, flow cytometry or other method.

In another example, a STAMP treated sample is mixed with luciferase and luciferin which reacts with the ATP released from the STAMP treated cells and the resulting luminescence is used to detected and quantify targeted cells.

VI. Kits.

In another embodiment this invention provides kits for the inhibition of an infection and/or for the treatment and/or prevention of dental caries in a mammal. The kits typically comprise a container containing one or more of the active agents (i.e., the antimicrobial peptide(s) and/or chimeric construct(s)) described herein. In certain embodiments the active agent(s) can be provided in a unit dosage formulation (e.g., suppository, tablet, caplet, patch, etc.) and/or may be optionally combined with one or more pharmaceutically acceptable excipients.

In certain embodiments the kits comprise one or more of the home healthcare product formulations described herein (e.g., toothpaste, mouthwash, tooth whitening strips or solutions, contact lens storage, wetting, or cleaning solutions, dental floss, toothpicks, toothbrush bristles, oral sprays, oral lozenges, nasal sprays, aerosolizers for oral and/or nasal application, and the like).

In certain embodiments kits are provided for detecting and/or locating and/or quantifying certain target microorganisms and/or cells or tissues comprising certain target microorganisms, and/or prosthesis bearing certain target microorganisms, and/or biofilms comprising certain target microorganisms. In various embodiments these kits typically comprise a chimeric moiety comprising a targeting moiety and a detectable label as described herein and/or a targeting moiety attached to an affinity tag for use in a pretargeting strategy as described herein.

In addition, the kits optionally include labeling and/or instructional materials providing directions (i.e., protocols) for the practice of the methods or use of the "therapeutics" or "prophylactics" or detection reagents of this invention. Certain instructional materials describe the use of one or more active agent(s) of this invention to therapeutically or prophylactically to inhibit or prevent infection and/or to inhibit the formation of dental caries. The instructional materials may also, optionally, teach preferred dosages/therapeutic regiment, counter indications and the like.

While the instructional materials typically comprise written or printed materials they are not limited to such. Any medium capable of storing such instructions and communicating them to an end user is contemplated by this invention. Such media include, but are not limited to electronic storage media (e.g., magnetic discs, tapes, cartridges, chips), optical media (e.g., CD ROM), and the like. Such media may include addresses to internet sites that provide such instructional materials.

EXAMPLES

The following examples are offered to illustrate, but not to limit the claimed invention.

Example 1

Design and Activity of a "Dual-Targeted" Antimicrobial Peptide

Numerous reports have indicated the important role of human normal flora in the prevention of microbial pathogenesis and disease. Evidence suggests that infections at mucosal surfaces result from the outgrowth of subpopulations or clusters within a microbial community, and are not linked to one pathogenic organism alone. In order to preserve the protective normal flora while treating the majority of infective bacteria in the community, a tunable therapeutic is necessary that can discriminate between benign bystanders and multiple pathogenic organisms. Here we describe the proof-of-principle for such a multi-targeted antimicrobial: a multiple-headed specifically-targeted antimicrobial peptide (MH-STAMP). The completed MH-STAMP, M8(KH)-20, displays specific activity against targeted organisms in vitro (*Pseudomonas aeruginosa* and *Streptococcus mutans*) and can remove both species from a mixed planktonic culture with little impact against untargeted bacteria. These results demonstrate that a functional, dual-targeted molecule can be constructed from widespectrum antimicrobial peptide precursor.

Introduction

For nearly 30 years antimicrobial peptides (AMPs) have been rigorously investigated as alternatives to small molecule antibiotics and potential solutions to the growing crisis of antibiotic resistant bacterial infections (Ganz (2003) *Nat Rev Immunol.*, 3: 710-720; Hancock and Lehrer (1998)., 16: 82-88). Numerous reports have characterized potential AMPs from natural sources, and a great body of work has been carried out designing "tailor-made" AMPs due to the approachable nature of solid-phase peptide synthesis (SPPS) (Genco et al. (2003) *Int J Antimicrob Agents,* 21: 75-78; He and Eckert (2007) *Antimicrob Agents Chemother.,* 51: 1351-1358). Several examples of the latter have shown remarkable activities in vitro against fungi, Gram-positive and Gram-negative bacteria, as well as some enveloped viruses (Brogden (2005) *Nat Rev Microbiol.* 3: 238-250).

Unlike small molecule antibiotics that may lose activity when their basic structures are modified even incrementally, peptides are a convenient canvas for molecular alteration. AMPs can be optimized through the incorporation of more or less hydrophobic or charged amino acids, which has been shown to affect selectivity for Gram-positive, Gram-negative or fungal membranes (Muhle and Tam J P (2001) *Biochemistry,* 40: 5777-5785; Tossi et al. (2000) *Biopolymers* 55: 4-30). Additionally, lysine residues can be utilized to improve AMP activity per µM. In this approach, multiple AMP chains can be attached to a single peptide scaffold through branching from lysine epsilon-amines (Tam et al. (2992) *Eur. J. Biochem.,* 269: 923-932; Pini et al. (2005) *Antimicrob Agents Chemother.,* 2005; 49: 2665-2672). AMP activity can be specifically tuned through the attachment of a targeting peptide region, as described for a novel class of molecules, the specifically-targeted antimicrobial peptides, or STAMPs (Eckert et al. (2006) *Antimicrob Agents Chemother.,* 50: 3651-3657; Eckert et al. (2006) *Antimicrob Agents Chemother.,* 50: 1480-1488). These chimeric molecules can consist of functionally independent targeting and killing moieties within a linear peptide sequence. A pathogenic bacterium recognized (i.e. bound) by the targeting peptide can be eliminated from a multi-species community with little impact to bystander normal flora. As an extension of this concept, we hypothesized that a STAMP could be constructed with multiple targeting peptide "heads" attached to a single AMP by utilizing a central lysine residue branch point. Potentially, targeting "heads" could be specific for the same pathogen, or have different binding profiles. Utilizing the former approach, microbial resistance evolution linked to a targeting peptide could be inhibited or reduced, as no single microbial population would have the genetic diversity necessary to mutate multiple discrete targeting peptide receptors in one cell (Drake et al. (1998) Genetics 148: 1667-1686).

Multi-headed STAMP (MH-STAMP) molecules with differing bacterial targets may have appeal in treating polymicrobial infections, or where it may be advantageous to remove a cluster of biofilm constituents without utilizing several distinct molecules; for example in the simultaneously treatment of dental caries and periodontitis, or in the eradication of the *Propionibacteria* spp. and *Staphylococcus* spp. involved in acne and skin infections, respectively.

In this example, we present the proof-of-principle design, synthesis and in vitro activity of such a MH-STAMP, M8(KH)-20. Previously, we identified two functional STAMP targeting domains, one with specific recognition of the cariogenic pathogen *S. mutans* (Eckert et al. (2006) *Antimicrob Agents Chemother.,* 50: 3651-3657), and the other with *Pseudomonas* spp.-level selectivity (Eckert et al. (2006) *Antimicrob Agents Chemother.,* 50: 3833-3838). Conjoined to a normally wide-spectrum linear AMP, we observed antimicrobial effects directed specifically to *P. aeruginosa* and *S. mutans* in vitro. Additionally, treatment of mixed bacterial communities with the multi-headed MH-STAMP resulted in the specific eradication of the target organisms with little impact on bystander population levels.

Materials and Methods

Bacterial Strains and Growth Conditions

*P. aeruginosa* ATCC15692, *Klebsiella pneumoniae* KAY 2026 (Sprenger and Lengeler (1984) *J Bacteriol.*, 157: 39-45), *Escherichia coli* DH5α (pFW5, spectinomycin resistance) (Podbielski et al. (1996) *Gene,* 177: 137-147), *Staphylococcus aureus* Newmann (Duthie and Lorenz (1952) *J Gen Microbiol.*, 6: 95-107), and *Staphylococcus epidermidis* ATCC35984 were cultivated under aerobic conditions at 37° C. with vigorous shaking Aerobic Gram-negative organisms were grown in Lauri-Bertaini (LB) broth and Gram-positive bacteria in Brain-heart infusion (BHI) broth. *Streptococcus mutans* JM11 (spectinomycin resistant, UA140 background) was grown in Todd-Hewitt (TH) broth under anaerobic conditions (80% N2, 15% $CO_2$, 5% H2) at 37° C. Merritt et al. (2005) *J Microbiol Meth.*, 61: 161-170. All bacteria were grown overnight to an OD600 of 0.8-1.0 prior to appropriate dilution and antimicrobial testing.

Synthesis of Multi-Head STAMP Peptides

Conventional solid-phase peptide synthesis (SPPS) methodologies were utilized for the construction of all peptides shown in FIG. 15 (Symphony Synthesizer, PTI, Tucson, Ariz.). Chemicals, amino acids, and synthesis resins were purchased from Anaspec (San Jose, Calif.). BD2.20 (FIRK-FLKKWLL (SEQ ID NO:3226), amidated c-terminus, mw 1491.92), an antimicrobial peptide developed in our laboratory with robust antimicrobial activity against a number of bacterial species (Table 19), served as the root sequence to which differing targeting peptides were attached: Firstly, BD2.20 was synthesized by SPPS (Rink-Amide-MBHA resin, 0.015 mmol), followed by the stepwise coupling of a functionalized alkane ($NH_2(CH_2)_7COOH$), and an Fmoc-protected Lys (side-chain protected with 4-methyltrityl (Mtt)) to the N-terminus. Standard SPPS methods were then employed for the step-wise addition of the *S. mutans* targeting peptide M8 plus a tri-Gly linker region (TFFRFLNR-GGG (SEQ ID NO:3227)) to the N-terminal of the central Lys. After assembly of Fmoc-M8-GGG-K(Mtt)-$(CH_2)_7$C0-BD2.20 (SEQ ID NO:3228), the Fmoc group was removed with 25% piperidine in DMF and the N-terminal was re-protected with an acetyl group with $Ac_2O$/DIEA (1:1, 20 molar excess) for 2 hours. The Mtt-protected amino group of the central Lys was then selectively exposed with 2% TFA in DCM (1.5 mL) for 15 minutes (three cycles of 5 min). The resulting product was reloaded into the synthesizer and the peptide sequence built from the Lys side-chain was completed with standard Fmoc SPPS methods. As shown in FIG. 15, the completed MH-STAMP M8(KH)-20 contained the side-chain peptide KH (*Pseudomonas* spp.-targeting, KKHRKHRKHRKH-GGG (SEQ ID NO:3229)), while in MH-STAMP M8(BL)-20 a peptide with no bacterial binding (data not shown), BL-1 (DAANEA-GGG), was utilized. BL(KH)-20 was constructed identically to M8(KH)-20, utilizing BL-1 in place of M8 (FIG. 15).

TABLE 19

MICs of MH-STAMPs and component peptides.

| | MIC (μM) | | | | | |
|---|---|---|---|---|---|---|
| | P. aeruginosa | E. coli | K. pneumoniae | S. mutans | S. epidermidis | S. aureus |
| BD2.20 | 14.4 ± 4.40 | 5.47 ± 1.41 | 2.98 ± 0.47 | 2.86 ± 0.60 | 5.11 ± 1.58 | 5.625 ± 1.29 |
| M8(KH)-20 | 11.95 ± 3.32 | 2.72 ± 0.59 | 3.13 | 6.25 | 3.13 | 5.64 ± 1.07 |
| M8(BL)-20 | 50 | 5.97 ± 0.94 | 6.88 ± 1.98 | 6.25 | 6.25 | 18.05 ± 6.58 |
| BL(KH)-20 | 27.5 ± 7.90 | 6.25 | 6.25 | 6.25 | 6.25 | 6.25 |

Average MIC with standard deviation, n = 10 assays.

Synthesis progression was monitored by the ninhydrin test, and completed peptides cleaved from the resin with 95% TFA utilizing appropriate scavengers, and precipitated in methyl tert-butyl ether. Purification and MH-STAMP quality was confirmed by HPLC (Waters, Milford, Mass.) using a linear gradient of increasing mobile phase (acetonitrile 10 to 90% in water with 0.1% TFA) and a Waters XBridge BEH 130 C18 column (4.6×100 mm, particle size 5 μm). Absorbance at 215 nm was utilized as the monitoring wavelength, though 260 and 280 nm were also collected. LC spectra were analyzed with MassLynx Software v.4.1 (Waters). Matrix-assisted laser desorption ionization (MALDI) mass spectroscopy was utilized to confirm correct peptide mass (Voyager System 4291, Applied Biosystems) (Anderson et al. (2008) *Biotechnol Lett.*, 30: 813-818).

MIC Assay

Peptides were evaluated for basic antimicrobial activity by broth microdilution, as described previously (Eckert et al. (2006) *Antimicrob Agents Chemother.*, 50: 3651-3657; Eckert et al. (2006) Antimicrob Agents Chemother., 50: 1480-1488). Briefly, ~1×105 cfu/mL bacteria were diluted in TH (*S. mutans*), or Mueller-Hinton (MH) broth (all other organisms) and distributed to 96-well plates. Serially-diluted (2-fold) peptides were then added and the plates incubated at 37° C. for 18-24 h. Peptide MIC was determined as the concentration of peptide that completely inhibited organism growth when examined by eye (clear well). All experiments were conducted 10 times.

Post-Antibiotic Effect Assay

The activity and selectivity of MH-STAMPs after a 10 min incubation was determined by growth retardation experiments against targeted and untargeted bacteria in monocultures, as described previously (Id.). Cells from overnight cultures were diluted to ~5×106 cfu/mL in MH (or TH with 1% sucrose for *S. mutans*), normalized by OD600 0.05-0.1 and seeded to 96-well plates. Cultures were then grown under the appropriate conditions for 2 h (3 h for *S. mutans*) prior to the addition of peptides for 10 min. Plates were then centrifuged at 3000×g for 5 min, the supernatants discarded, fresh medium returned (MH or TH without sucrose for *S. mutans*), and incubation resumed. Bacterial growth after treatment was then monitored over time by OD600.

Microbial Population Shift Assay

Mixed planktonic populations of *P. aeruginosa, E. coli, S. epidermidis*, and *S. mutans* were utilized to examine the potential of MH-STAMPs to direct species composition within a culture after treatment. Samples were prepared containing: ~6×10$^4$ cfu/mL S. mutans, ~2×10$^4$ cfu/mL E. coli, ~2×10$^4$ cfu/mL S. epidermidis, and ~0.5×10$^4$ cfu/mL P. aeruginosa in BHI (mixed immediately before peptide addition). Peptide (10 µM) or mock-treatment (1×PBS) was then added and samples were incubated at 37° C. for 24 h under anaerobic conditions (80% N$_2$, 15% CO$_2$, 5% H$_2$). After incubation, samples were serially diluted (1:10) in 1×PBS and aliquots from each dilution were then spotted to agar plates selective for each species in the mixture: TH plus 800 µg/mL spectinomycin (S. mutans), LB plus 25 µg/mL ampicillin (P. aeruginosa), LB plus 200 µg/mL spectinomycin (E. coli), and mannitol salt agar (MSA, S. epidermidis) in order to quantitate survivors from each species. Plates were then incubated 37° C. under aerobic conditions (TH plates were incubated anaerobically) and colonies counted after 24 h to determine survivors. Expected colony morphologies were observed for each species when plated on selective media. Gram stains and direct microscopic observation (from select isolated colonies) were undertaken to confirm species identity (data not shown). The detection limit of the assay was 200 cfu/mL.

Results

Design and Synthesis of Multi-Headed STAMPs

Figure 16A:
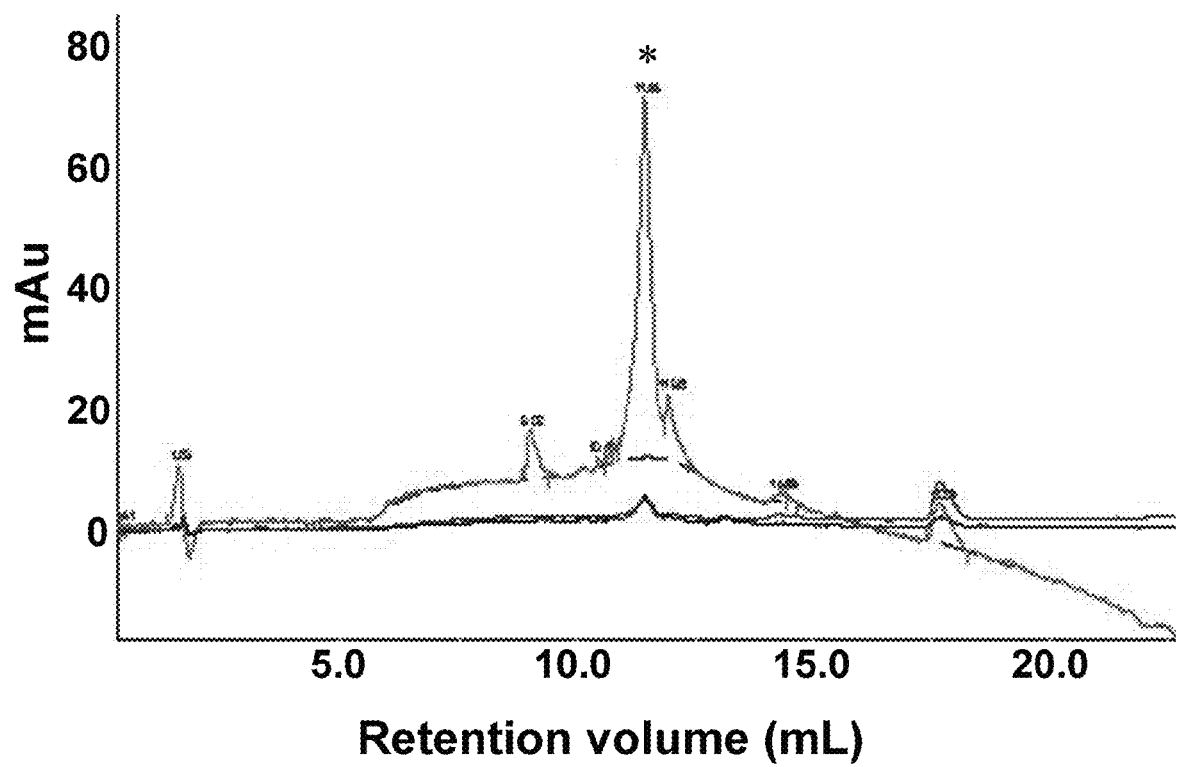
FIGS. 16A and 16B show HPLC and MS spectra of M8(KH)-20. The quality of the completed MH-STAMP was analyzed by HPLC (FIG. 16A) and MALDI mass spectroscopy (FIG. 16B). At UV absorbance 215 nm (260 and 280 nm are also plotted), a single major product was detected by HPLC (* retention volume 11.04 mL). After fraction collection, the correct mass (m/z) for single-charged M8(KH)-20, 4884.91 (marked by *), was observed for this peak. Y-axis: 16A, mAU miliabsorbance units; 16B, percent intensity.
Figure 16B:
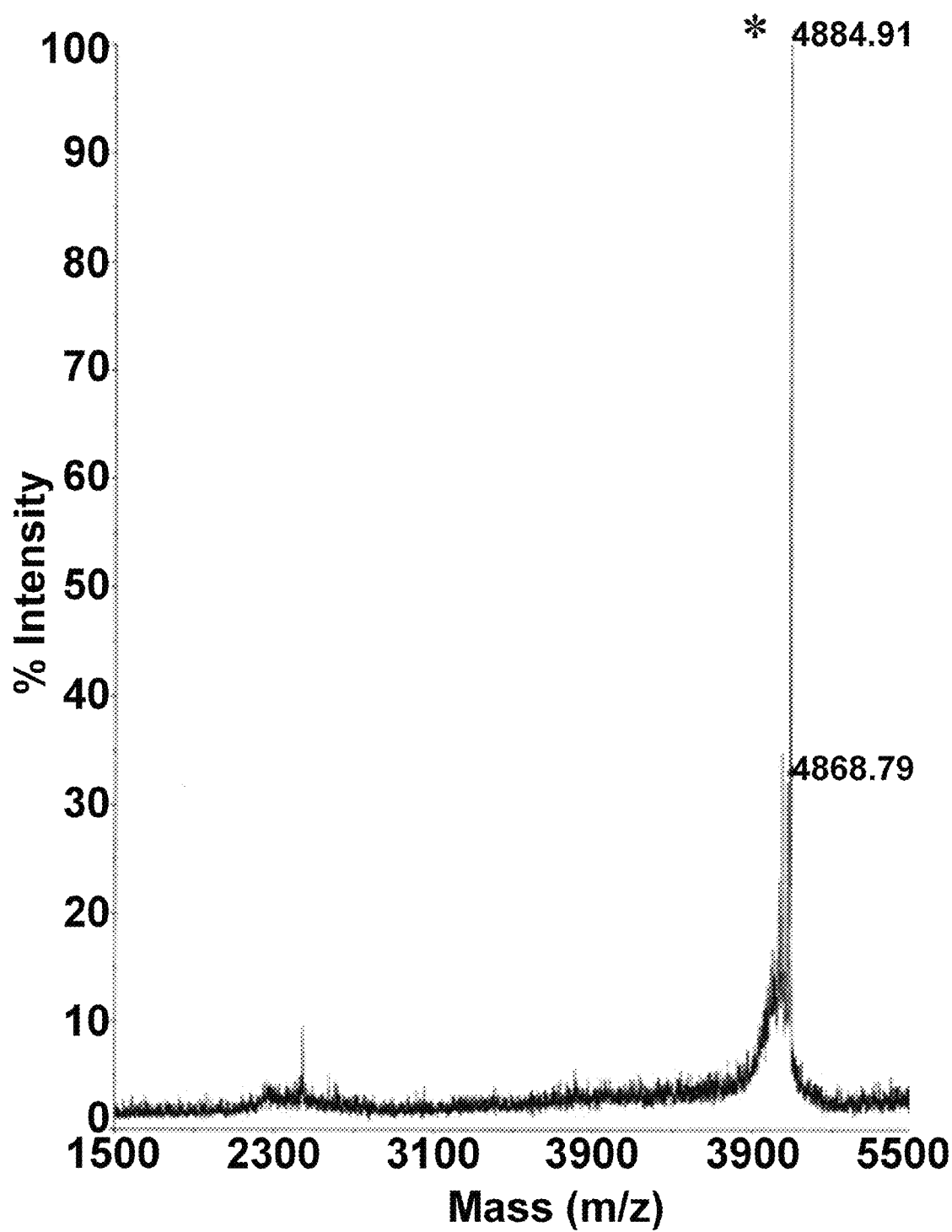

We constructed a prototype MH-STAMP from the well-established targeting peptides KH (specific to *Pseudomonas* spp) and M8 (specific for *Streptococcus mutans*). The wide-spectrum antimicrobial peptide BD2.20 was utilized as the base AMP for all MH171 STAMP construction. BD2.20 is a novel synthetic AMP with a cationic and amphipathic residue arrangement, which has robust MICs against a variety of Gram-negative and Gram-positive organisms (Table 19). For the synthesis of MH-STMAP M8(KH)-20 (construct presented in FIG. 15), BD2.20 and a Lys (Mtt-protected sidechain) residue were joined via an activated alkane spacer, followed by addition of the M8 targeting peptide to the N-terminus of the product. Selective deprotection of the central Lys(Mtt) side chain was then undertaken and the KH targeting peptide attached. The correct molecular mass (4888.79) and ~90% purity was confirmed by HPLC and MALDI mass spectrometry (FIG. 16).

The non-binding "blank" targeting peptide BL-1 was incorporated into the synthesis scheme in place of KH or M8 to construct variant MH-STAMPs possessing a single functional targeting head: M8(BL)-20 and BL(KH)-20. The correct MW and acceptable purity were observed for these MH-STAMPs (FIG. 15, data not shown).

General Antimicrobial Activity of Multi-Head Constructs

After synthesis, the completed MH-STAMPs were evaluated for general antimicrobial activity by MIC against a panel of bacteria. As shown in Table 19, the MH-STAMP constructs M8(KH)-20, BL(KH)-20, and M8(BL)-20 were found to have similar activity profiles to that of BD2.20 for the organisms examined (less than two titration steps in 10-fold difference). Additionally, we observed a difference in general susceptibility between P. aeruginosa and the other organisms tested, suggesting this bacterium is more resistant to BD2.20. Overall, these data indicate that the addition of the targeting domains to the base sequence was tolerated and did not completely inhibit the activity of the antimicrobial peptide.

Peptide selectivity could not be determined utilizing these methods, as STAMPs and their parent AMP molecules often display similar MICs, but have radically different antimicrobial kinetics and selectivity due to increased specific-killing mediated by the targeting regions (Id.). Therefore, we performed different experiments to test for antimicrobial selectivity and functional MH-STAMP construction.

Selectivity and Post-Antibiotic Effect of MH-STAMP Constructs

Figure 17A:
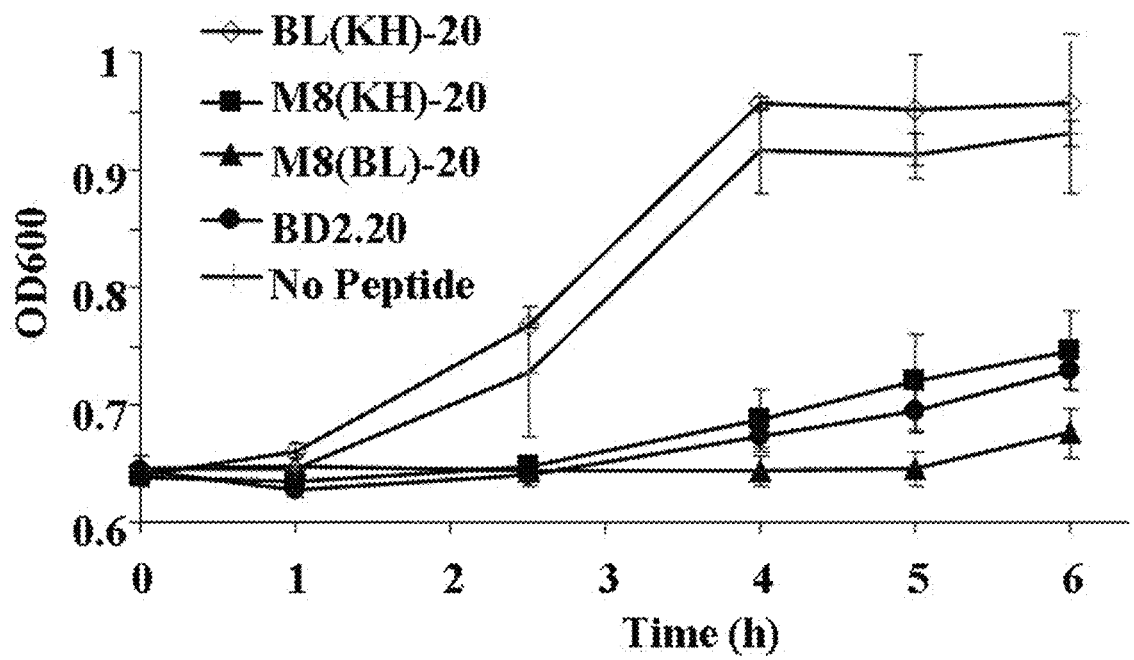
FIG. 17A-17E show growth inhibitory activity of MH-STAMPs. Monocultures of S. mutans (FIG. 17A); P. aeruginosa (FIG. 17B); S. epidermidis (FIG. 17C); S. aureus (FIG. 17D); or E. coli (FIG. 17E); were treated with peptides (as indicated in the figure) for 10 min. Agent was then removed and fresh media returned. Culture recovery was measured over time (OD600). Plots represent the average of at least 3 independent experiments with standard deviations.
Figure 17B:
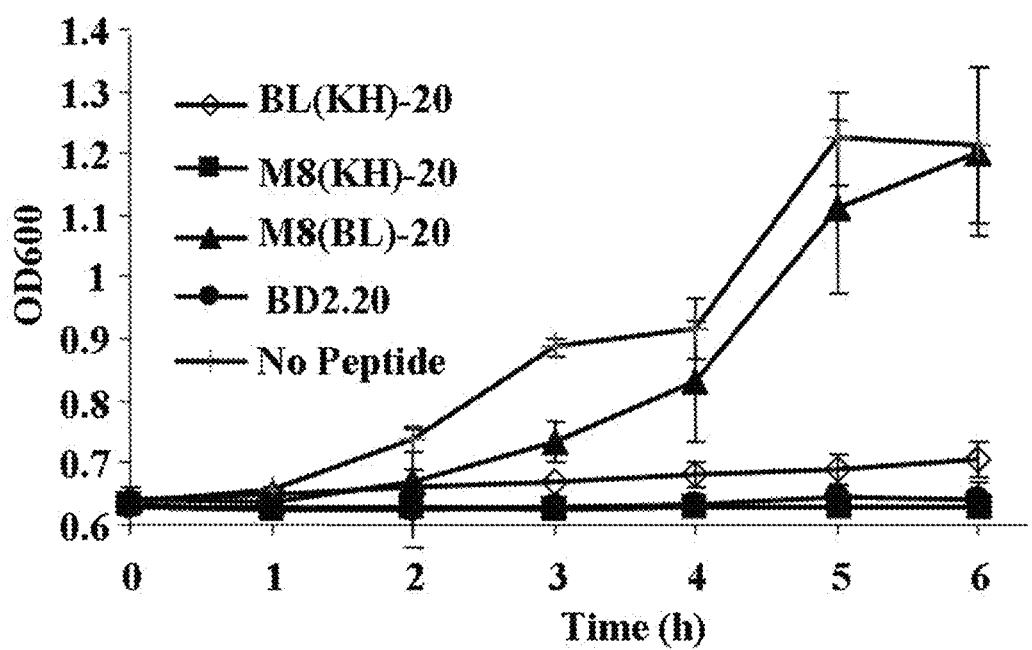
Figure 17C:
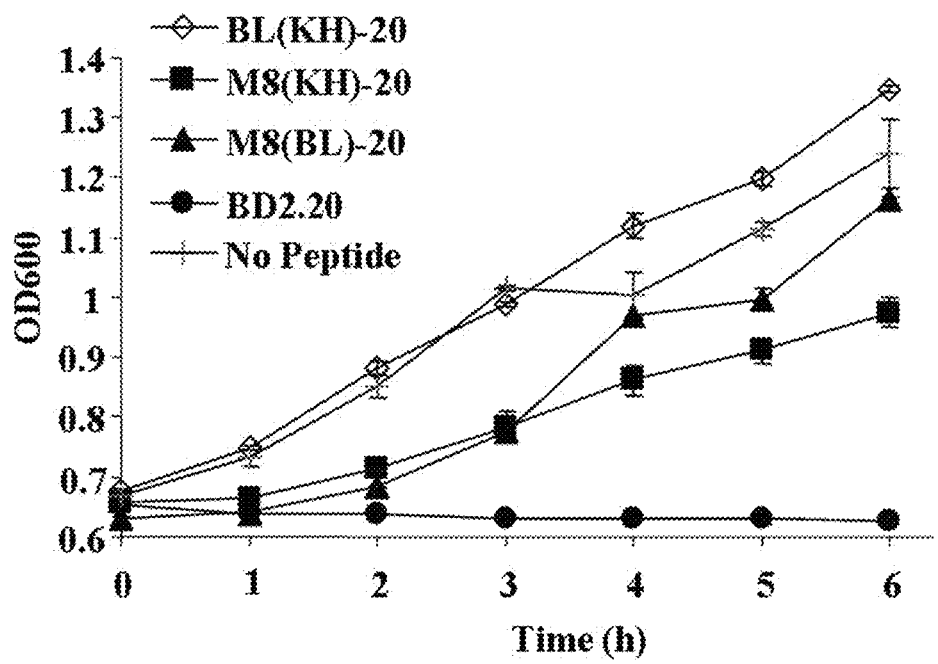
Figure 17D:
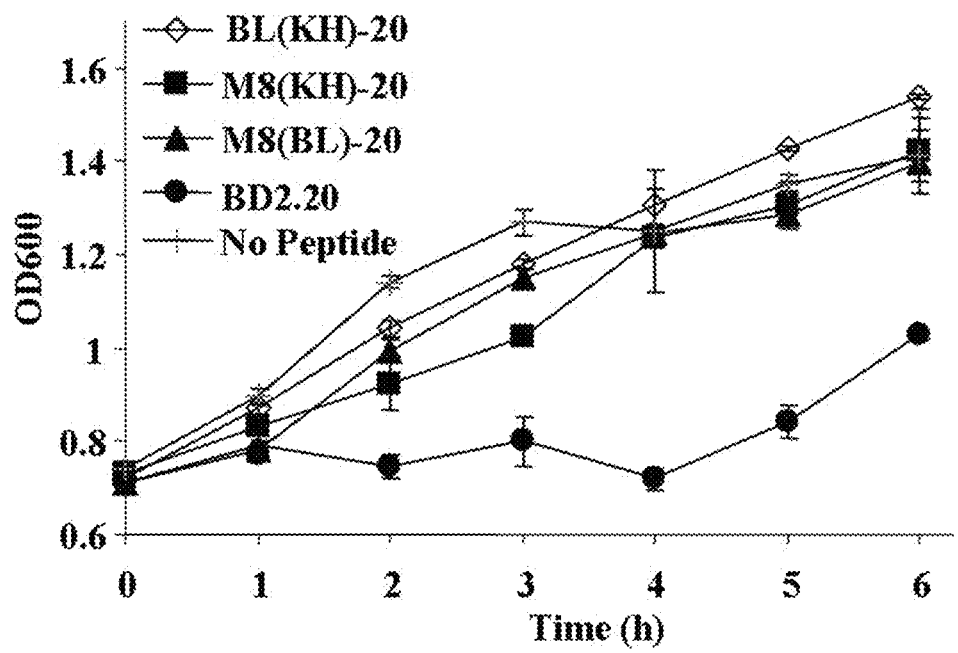
Figure 17E:
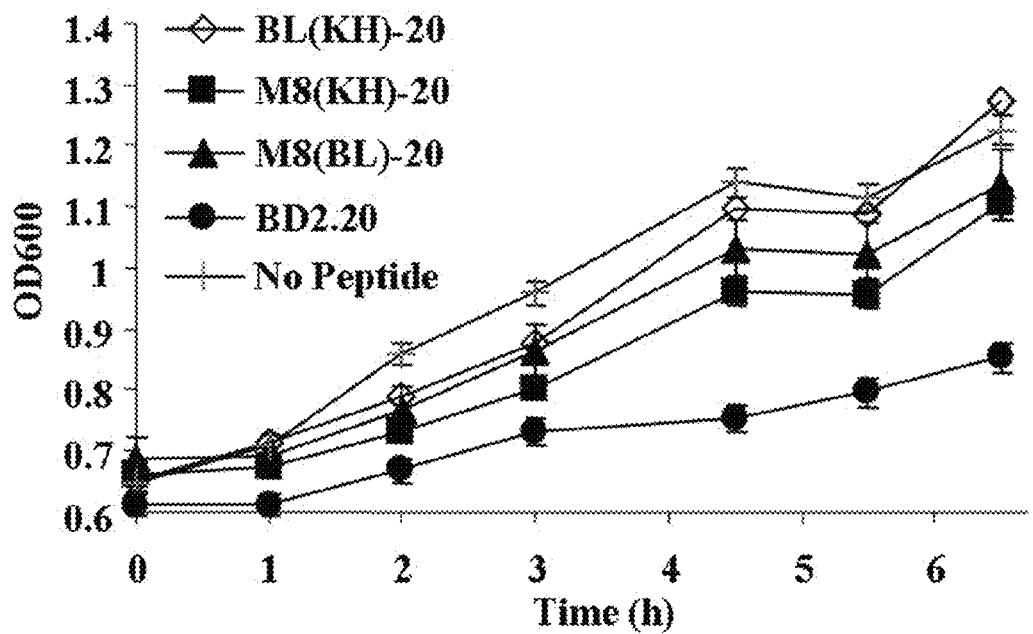

MH-STAMP antimicrobial kinetics was ascertained utilizing a variation of the classical post-antibiotic effect assay, which measures the ability of an agent to affect an organism's growth after a short exposure period. Monocultures of MH-STAMP-targeted and untargeted organisms were exposed to M8(KH)-20, M8(BL)-20, BL(KH)-20, or unmodified BD2.20, then allowed to recover. As shown in FIG. 17A, S. mutans growth was effectively retarded by M8-containing constructs (M8(KH)-20, M8(BL)-20), but was not altered by a MH-STAMP construct lacking this region (BL(KH)-20). Similarly, the growth of the other targeted bacterium, P. aeruginosa, was inhibited in a KH-dependant manner (FIG. 17B). In comparison, the non-targeted bacteria E. coli, S. aureus, and S. epidermidis were not inhibited by treatment with any MH-STAMP and were only inhibited by the base antimicrobial peptide BD2.20, which displayed robust antimicrobial activity against all examined strains. These results indicate that MH-STAMPs containing KH or M8 targeting domains have activity against P. aeruginosa or S. mutans, respectively, and not other bacteria. Furthermore, replacement of the targeting region with a non-binding peptide abolishes specific activity.

Figure 18:
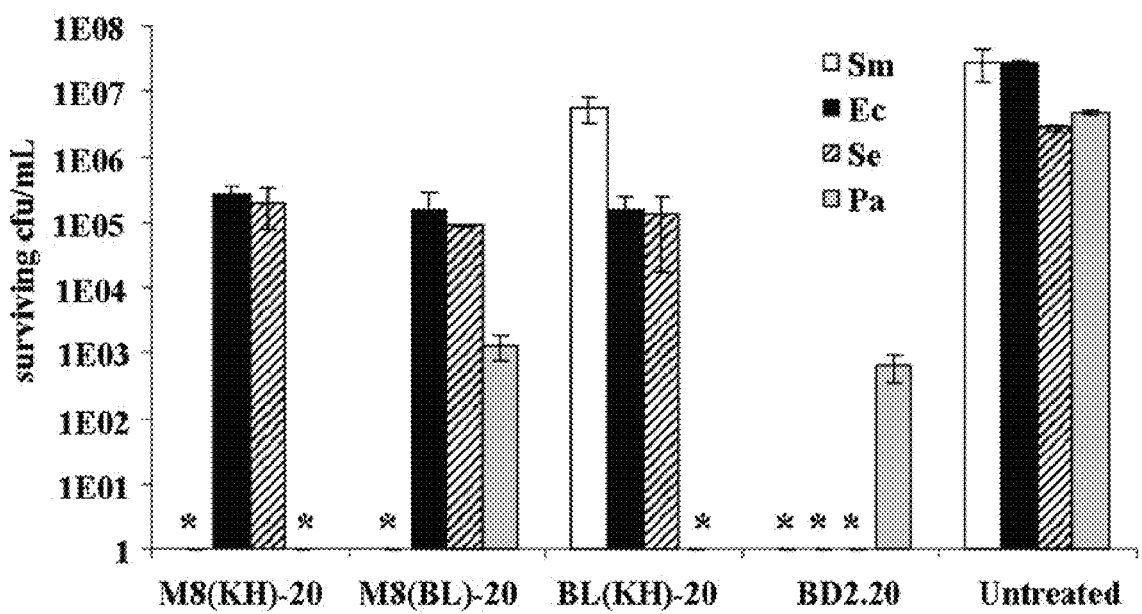
FIG. 18 illustrates the selective activity of dual-targeted and single-targeted MH-STAMPs in mixed culture. A mixture of P. aeruginosa (Pa), S. mutans (Sm), E. coli (Ec), and S. epidermidis (Se) planktonic cells were mixed with MH-STAMPs (as indicated in the figure) and treated 24 h. After incubation, cfu/mL of remaining constituent species were quantitated after plating to selective media. * indicates under 200 surviving cfu/mL recovered.

Ability of MH-STAMPs to Direct a "Population Shift" within a Mixed Species Population We hypothesized that potential MH-STAMP dual-functionality could affect a particular set of bacteria within a mixed population, thereby promoting the outgrowth of non-targeted organisms and "shifting" the constituent makeup. To examine this possibility, defined mixed populations of planktonic cells were treated continuously and the make-up of the community examined after 24 h. As shown in FIG. 18, treatment with the wide spectrum AMP BD2.20 resulted in a significant loss of recoverable cfu/mL after 24 h from all species in the mixture. Treatment with M8(KH)-20 was found to alter this pattern; we observed ~1×10$^5$ cfu/mL surviving E. coli and S. epidermidis, but did not recover S. mutans or P. aeruginosa cfu/mL. In BL(KH)-20 treated samples, P. aeruginosa cfu/mL were not observed, though we recovered higher than input cfu/mL from S. mutans and unchanged numbers of S. epidermidis and E. coli. In samples exposed to M8(BL)-20, S. mutans recoverable cfu/mL were greatly reduced compared to input cfu/mL, while other species were not affected or affected to a lesser extent. Interestingly, these results suggest that M8(KH)-20, M8(BL)-20, and BL(KH)-20 retain their ability to affect organisms recognized by the targeting regions present, even within a mixed population of bacteria.

Discussion

Our results indicate that we have successfully constructed a STAMP with dual antimicrobial specificities controlled by the targeting peptides present in the molecule; KH for *Pseudomonas* spp, M8 for S. mutans. In a closed multi-species system (FIG. 18), the dual specificity of M8(KH)-20 was readily discernable: the population of the culture "shifted" away from targeted organisms after MH-STAMP treatment. The targeted bacteria were eliminated and the population of untargeted organisms increased, to varying degrees, above-input cfu/mL. Additionally, interruption of KH or M8 in the MH-STAMP construct with the non-binding peptide BL-1 resulted in the expected elimination of only one targeted species. These results support the hypothesis that functional MH-STAMPs could be constructed from a wide-spectrum AMP base.

The emergence of metagenomics and the development of more sensitive molecular diagnostics has driven an increase in the understanding of human-associated microbial ecologies and host-microbe interactions (Aas et al. (2005) *J Clin Microbiol.*, 43: 5721-5732; Boman (2000) *Immunol Rev.*, 173: 5-16; Kreth et al. (2005) *J Bacteriol.*, 187: 7193-7203). At mucosal surfaces, it has become clear that our bodies harbor an abundance of residential flora which may impact innate and humoral immunity, nutrient availability, protection against pathogens, and even host physiology (Metges (2000) *J Nutr.*, 130: 1857S-64; Sears (2005) Anaerobe, 11: 247-251; Lievin-Le et al. (2006) *Clin Microbiol Rev.*, 19: 315-337; DiBaise et al. (2008) *Mayo Clinic Proceedings* 83: 460-469). Furthermore, findings have indicated that shifts in the diversity of normal flora are associated with negative clinical consequences; for example the overgrowth of *S. mutans* in the oral cavity during cariogenesis (linked to the uptake of sucrose) or the antibiotic-assisted colonization of the intestine by *Clostridium difficle* (Loesche (1986) *Microbiol Rev.*, 50: 353-380; Gould and McDonald (2998) *Crit. Care* 12: 203). Other population shifts may be linked to axilla odor (*Corynebacteria* spp) (Leyden et al. (1981) *J Invest Dermatol.*, 77: 413-416; Elsner (2006) *Curr Probl Dermatol.*, 33: 35-41), or even host obesity. Given the quantity and diversity of microbes present, pathogenesis at mucosal surfaces is not likely to be associated with the overgrowth of a single strain or species. More often, it is a population shift resulting in the predominance of two or more species; for example the persistence of *Burkholderia cepacia* and *P. aeruginosa* in cystic fibrosis airway or *Treponema denticola* and *Porphymonas gingivalis* and other "red cluster" organisms in gingivitis (Govan and Deretic (1996) *Microbiol Rev.*, 60: 539-574; Paster et al. (2001) *J Bacteriol.*, 183: 3770-3783). In many cases (such as the latter) these species may have only distant phylogenetic relationships and display differential susceptibilities to antibiotic therapies resulting in persistent disease progression despite treatment (Schlessinger (1988) *Clin Microbiol Rev.*, 1: 54-59; Tresse et al. (1997) *J Antimicrob Chemother.*, 40: 419-421). Currently, available treatments for infections of mucosal surfaces are largely non-specific (traditional small-molecule antibiotics, mechanical removal), and thus are not effective in retaining flora or shifting the constituent balance back to a health-associated composition (Keene and Shklair (1974) *J Dent Res.*, 53: 1295). There is a need for a therapeutic treatment that can selectively target multiple pathogens, regardless of their phylogenetic relationship, and MH-STAMPs can help achieve this goal.

In monoculture experiments (FIG. 17), our results suggest that M8 or KH inclusion in the MH-STAMP drove activity towards *S. mutans* or *P. aeruginosa*, but also that the presence of a targeting domain reduced the activity of the parent AMP BD2.20 against untargeted organisms. In contrast, the results of our MIC assays (Table 19) indicate little difference in activity between BD2.20 and any MH-STAMP. Against untargeted organisms, the M8 and KH regions are likely to have a negative, but not completely inhibitory, impact on BD2.20 activity. Given the long duration of activity and the lower inoculum size in the MIC assay (compared with experiments in FIG. 17), it is likely that all BD2.20-containing peptides could reach equal levels of growth inhibition, despite large and target-specific differences in antimicrobial speed. This pattern of results was also observed when comparing MICs of targeted and untargeted organisms utilizing STAMPs against *S. mutans* and *Pseudomonas mendocina* (Eckert et al. (2006) *Antimicrob Agents Chemother.*, 50: 3651-3657; Eckert et al. (2006) *Antimicrob Agents Chemother.*, 50: 1480-1488).

Although more rigorous studies and a more medically relevant combination of pathogen targets is desirable, these findings indicate that it is possible to design an antimicrobial peptide-based therapeutic with multiple and defined fidelities in vitro. MH-STAMPs may help improve human health through the promotion of healthy microbial constituencies.

Example 2

Synthesis of Peptide—Porphyrin Conjugate

The mixture of coupling reagent HATU (5 eq. excess, 10 mg) and purpurin-18 (MW 564, 5 eq excess, 15 mg) in 600 mL dry dichloromethane (DCM):DMF:dimethylsulphoxide (DMSO) (1:1:1 (v/v)) was added to the peptide resin (1 molar equivalent, 15 mg) which was swelled by placing in minimal DMF for 30 min prior to reaction. 26 μL (10 molar equivalents) DIPEA was then added to the reaction flask to initiate the reaction. The reaction mixture was protected with argon and stirred at room temperature for 3 h.

After finishing, the reaction mixture was then passed down a sintered glass filtered vial and extensively washed with DMF and DCM to remove all waste reagents. The resin was then dried overnight in vacuum, and cleaved with 1 ml of trifluoroacetic acid (TFA)/thioanisole/water/EDT (10/0.5/0.5/025) for 2 hr at room temperature, and the cleavage solution was precipitated with 10 mL methyl-tert butyl ether. The precipitate was washed twice with the same amount of ether.

Example 3

Synthesis of Peptide—CSA Conjugate

To the fully protected peptide (solution of B43-GGG (FIDSFIRSF-GGG, 0.025 mmol) and tri-Boc-CSA-15 (0.0125 mol) in 300 μL DMF, DCC (7.7 mg), HOBt (5.1 mg) and 13 μL DIEA were added in iced-bath. After stirred at room temperature for four days, the reaction mixture was poured into 5 ml water and extracted with chloroform (5×3 mL). The $CHCl_3$ extract was evaporated under vacuum and dried in a lyophilizer overnight. The dried $CHCl_3$ extracts was then dissolved in 1 mL DCM followed by added 1 mL of TFA in iced-bath. The reaction mixture was further stirred at room temperature for 2 hours and precipitated with methyl tert-butyl ether (10 mL). The precipitate was further washed once with the same amount ether and dried in vacuum.

Example 4

STAMPs Against *Corynebacterium jeikeium* and *Streptococcus mutans*

This example illustrates the development of STAMPs to selectively target and reduce or eliminate *Streptococcus mutans* (dental caries) or *Corynebacterium* jeikeium (body odor, opportunistic infections) from mixed microbial populations.

Axilla odor is caused by overgrowth of, and metabolite production from, *Corynebacterium* spp, which replaces *Staphylococcus* and *Micrococcus* spp associated with less odor. Current hygiene (soaps, antibiotics, antiseptics, disinfectants) practices remove all bacteria, allowing the ratio of *Corynebacteria* to normal flora to remain high during regrowth. Deodorants and anti-perspirants are temporary solutions that hide or even exacerbate the problem.

*S. mutans* is the major etiological agent of dental caries. Current methods (tooth brushing, antiseptic mouthrinses) to treat cariogenesis have focused on complete bacterial removal, i.e., elimination of *S. mutans* and other harmless oral bacteria. Caries have persisted despite these methods, and in many cases, *S. mutans* can become the dominant organism in the mouth. Several *S. mutans* and acid-targeted approaches (probiotic replacement, saliva pH adjustment) are under development, but none have shown clinical efficacy.

This example describes a number of STAMPs that preferentially or selectively reduce or eliminate *S mutans* and/or *Corynebacterium* spp from mixed populations.

Several lead STAMPs with specific activity against *Corynebacterium jeikeium* are also disclosed herein.

The STAMPs described herein comprise functional regions within a peptide molecule or a chemical conjugate. These regions include a targeting region comprising one or more targeting moieties (e.g., targeting peptides), a linker, and one or more killing moieties (e.g., antimicrobial peptides (AMPs), porphyrins, etc.).

The STAMPs function through the targeting region, which selectively accumulates STAMPs, and therefore killing regions, on or in proximity to the microorganism of interest. Other flora are not recognized by the targeting region, and therefore avoid or have reduced STAMP accumulation and cellular damage.

In certain embodiments, STAMPs against oral *S. mutans* are best applied formulated in a mouthrinse, toothpaste, cream, gel, or adhesive strip, and in certain preferably embodiments, are provided in a formulation that comprises 0.5 to 2.5×PBS (or other salt) and other ingredients commonly found in oral healthcare formulations (e.g., mouthrinse formulations). Certain illustrative formulations are shown in Table 20.

During the course of evaluating STAMPs, antimicrobial peptides (AMPs), and binding peptides for desired activity, it was discovered that certain formulations can attenuate or promote peptide activity, as compared to activity levels in a default buffer system (1×PBS). In some cases, 1×PBS may provide the best level of activity. Below are a number of formulations that alter, or may alter, peptide or STAMP activity. For complex buffer systems, assume the base solvent is water unless otherwise stated.

Formulation 1 (1×PBS, pH 7.4): 136.8 mM NaCl, 2.68 mM KCl, 1.01 mM $Na_2HPO_4$, and 1.37 mM $KH_2PO_4$.

Formulation 2 (HEPES/CTAB): 20 mM HEPES (4-(2-hydroxyethyl)-1-piperazineethanesulfonic acid), 150 mM NaCl, 1 mM $MgCl_2$, and 0.1% CTAB (Cetyl trimethylammonium bromide).

Formulation 3 (TRIS/CTAB): 20 mM Tris (tris(hydroxymethyl)aminomethane), pH 7.5, 150 mM NaCl, 1 mM $MgCl_2$, and 0.1% CTAB.

Formulation 4: 20 mM HEPES.

Formulation 5: 20 mM Tris, pH 7.5.

Formulation 6: 0.2% CTAB.

Formulation 7: 1% Glycerol.

Formulation 8: 1% Pluronic F108 (nonionic surfactant: α-Hydro-.omega.-hydroxypoly(oxyethylene)poly(oxypropylene)poly(oxyethylene) block copolymer).

Formulation 9: 1% Pluronic F123 (Poly(ethylene glycol)-block-poly(propylene glycol)-block-poly(ethylene glycol), average $M_n$~5,800).

Formulation 10: 1% Pluronic F17R4 (Poly(propylene glycol)-block-poly(ethylene glycol)-block-polypropylene glycol), average $M_n$~2,700).

Formulation 11: 1% to 7% PEG400.

Formulation 12: 50 mM Urea.

Formulation 13: 10 mM AOT (Sodium bis(2-ethylhexyl) sulfosuccinate).

Formulation 14: 0.5-0.1% Tween 20 (nonionic detergent, also known as polysorbate 20 or PEG(20) sorbitan monolauratesorbitan monolaurate).

Formulation 15: 0.5-0.1% Tween 80 (nonionic surfactant, $C_{64}H_{124}O_{26}$, also known as polyoxyethylene (20) sorbitan monooleate, (x)-sorbitan mono-9-octadecenoate poly(oxy-1, 2-ethanediyl), or POE (20) sorbitan monooleate).

Formulation 16: 5-10% Ethanol.

Formulation 17: 20% Glycerin.

Formulation 18: 20% Sorbitol.

Formulation 19: 10% Glycerin/10% Sorbitol.

Formulation 20: 0.1% SLS (Sodium lauryl sulfate).

Formulation 21: 1% Pluronic F127 (nonionic suffactant: α-Hydro-.omega.-hydroxypoly(oxyethylene)poly(oxypropylene)poly(oxyethylene) block copolymer).

Formulation 21: 0.1% Tween 20 (nonionic detergent, also known as Polysorbate 20, or PEG(20)sorbitan monolaurate).

Formulation 21: 10% PG (phospholipid gel).

Mouthrinse neat solution #1 (made in 1×PBS): 7% ETOH, 20% Glycerin, 7% PEG 400, and 1% PLURONIC® F127.

Mouthrinse neat solution #2 (made in 1×PBS): 7% ETOH, 20% Sorbitol, 7% PEG 400, and 1% PLURONIC® F127.

Mouthrinse neat solution #3 (made in 1×PBS): 7% ETOH, 20% Glycerin and 7% PEG 400.

Mouthrinse neat solution #4 (made in 1×PBS): 7% ETOH, 20% Sorbitol and 7% PEG 400.

Other illustrative, but not limiting, mouthrinse formulations are shown in Table 20.

TABLE 20

Illustrative mouthrinse formulations.

| Rinse# | ETOH | Glycerin | PEG400 | F127 | Water[1] | Fluoride |
|---|---|---|---|---|---|---|
| 1 | 5 | 22.5 | 7 | 1 | 64.5 | 187.5 |
| 2 | 6 | 25 | 1 | 0 | 68 | 0 |
| 3 | 6 | 20 | 7 | 0 | 67 | 0 |
| 4 | 6 | 20 | 1 | 1 | 72 | 0 |
| 5 | 7 | 25 | 7 | 0 | 61 | 0 |
| 6 | 7 | 20 | 1 | 0 | 72 | 0 |
| 7 | 7 | 20 | 7 | 0 | 66 | 250 |
| 8 | 5 | 20 | 7 | 1 | 67 | 0 |
| 9 | 6.472 | 21.139 | 5.361 | 0.722 | 66.306 | 250 |
| 10 | 7 | 22.5 | 1 | 0 | 69.5 | 250 |
| 11 | 5 | 25 | 1 | 0 | 69 | 250 |
| 12 | 7 | 20 | 7 | 0 | 66 | 250 |
| 13 | 5 | 20 | 1 | 1 | 73 | 250 |
| 14 | 5 | 25 | 7 | 0.5 | 62.5 | 250 |
| 15 | 7 | 25 | 1 | 0.5 | 66.5 | 250 |
| 16 | 7 | 25 | 7 | 1 | 60 | 250 |
| 17 | 5 | 25 | 7 | 0.5 | 62.5 | 0 |
| 18 | 7 | 20 | 1 | 1 | 71 | 250 |
| 19 | 6 | 25 | 1 | 1 | 67 | 250 |
| 20 | 7 | 25 | 7 | 1 | 60 | 125 |
| 21 | 5 | 25 | 1 | 0 | 69 | 250 |
| 22 | 5 | 20 | 1.5 | 0.5 | 73 | 0 |
| 23 | 7 | 20 | 1 | 1 | 71 | 250 |
| 24 | 6 | 20 | 1 | 0 | 73 | 250 |
| 25 | 5 | 22.333 | 3.778 | 0.444 | 68.444 | 125 |
| 26 | 7 | 25 | 1 | 1 | 66 | 0 |
| 27 | 6 | 25 | 7 | 0 | 62 | 250 |
| 28 | 7 | 20 | 7 | 1 | 65 | 0 |
| 29 | 7 | 25 | 4 | 1 | 63 | 62.5 |
| 30 | 5 | 25 | 4 | 0 | 66 | 0 |
| 31 | 5 | 25 | 1 | 1 | 68 | 0 |
| 32 | 7 | 25 | 7 | 1 | 60 | 0 |
| 33 | 7 | 22.5 | 4 | 0.5 | 66 | 0 |
| 34 | 5 | 20 | 4.5 | 0 | 70.5 | 250 |
| 35 | 5 | 23 | 1 | 0 | 71 | 62.5 |
| 36 | 6 | 20 | 1 | 1 | 72 | 0 |
| 37 | 5 | 20 | 7 | 0 | 67 | 250 |
| 38 | 7 | 20 | 1 | 0 | 72 | 0 |
| 39 | 5 | 25 | 4 | 1 | 65 | 250 |
| 40 | 5 | 22.5 | 7 | 0 | 65.5 | 0 |
| n1 | 7 | 20 | 7 | 1 | 65 | 0 |
| n2 | 7 | 20% Sorbitol | 7 | 1 | 65 | 0 |
| n3 | 7 | 20 | 7 | 0 | 66 | 0 |
| n4 | 7 | 20% Sorbitol | 7 | 0 | 66 | 0 |

[1] 1×PBS can be substituted for water

In certain embodiments, *Corynebacterium*-specific STAMPs are formulated in any number of creams, nanoemulsions, lipid micelles, aqueous or no-aqueous gels, sprays, soaps or roll-on bars, or other products used for axilla or other hygiene.

STAMP-mediated selective antimicrobial activity can result in preservation of the normal flora at the oral or axilla mucosal surface, resulting in protective colonization and the conversion of a harmful flora to a beneficial one. Recurrence of pathogen overgrowth would be reduced, which also limits the amount and frequency (and therefore cost) of STAMP delivery. STAMPs allow for "surgical" antimicrobial precision, which limits antimicrobial resistance evolution as well due to the general mechanism of cell membrane damage mediated by the killing region.

A number of anti-*S. mutans* STAMPs (see Table 21) and anti-*C. jeikeium* STAMPs have been designed and tested, some in formulations. All show potent selective activity against their bacterial targets in vitro, including against biofilm forms. When tested, STAMPs have little cytotoxicity against cell lines in vitro.

TABLE 21

Illustrative anti-*S. mutans* STAMPs.

| STAMP | Amino Acid Sequence | SEQ ID NO |
|---|---|---|
| 2_1G2 | FIKHFIHRFGGGKNLRIIRKGIHIIKKY* | 3230 |
| C16AF5 | TFFRLFNRSFTQALGKGGGFLKFLKKFFKKLKY* | 3231 |
| 1845L621 | KFINGVLSQFVLERKPYPKLFKFLRKHLL* | 3232 |
| 1903-21 | NIFEYFLEGGGKLFKFLRKHLL* | 3233 |

Single underline is binding peptide.
Double underline is antimicrobial peptide (AMP).
No underline is linker.
*indicates optionally protected (e.g., amidated) C terminal.

TABLE 22

Illustrative anti-*C. jeikeium* STAMPs.

| STAMP | Amino Acid Sequence | SEQ ID NO |
|---|---|---|
| 2038L6CAM135 | GKAKPYQVRQVLRAVDKLETRRKKGGR PYPGWRLIKKILRVFKGL* | 3234 |
| 1619-CAM135 | SKRGRKRKDRRKKKANHGKRPNSGGGG WRLIKKILRVFKGL* | 3235 |
| 1599-BD2.16 | YSKTLHFADGGGKILKFLFKKVF* | 3236 |
| 1619-BD2.16 | SKRGRKRKDRRKKKANHGKRPNSGGG KILKFLFKKVF* | 3237 |
| 1904-BD2.16 | GSVIKKRRKRMSKKKHRKMLRRTRVQR RKLGKGGGKILKFLFKKVF* | 3238 |

Single underline is binding peptide.
Double underline is antimicrobial peptide (AMP).
No underline is linker.
*indicates optionally protected (e.g., amidated) C terminal.

It was a surprising discovery that certain anti-*S. mutans* STAMPs required a salt in the formulation (e.g., PBS) for optimum activity. Thus, for example, the anti-*S. mutans* STAMP C16G2 (TFFRLFNRSFTQALGKGGGKNLRI-IRKGIHIIKKY*, SEQ ID NO:2) comprising the TFFR-LFNRSFTQALGK (SEQ ID NO:1) attached to the antimicrobial peptide (AMP) KNLRIIRKGIHIIKKY (SEQ ID NO: 3080) by a peptide linker (GGG) was substantially inactive in water-based salt-free buffers and nanoemulsions, but was active in a phosphate buffered saline (PBS) formulation. Suitable PBS formulations ranged from 0.5×PBS to about 2.5× PBS with an activity optimum at about 1×PBS. Similar results are believed to obtain for other anti-*S. mutans* STAMPS as well as a number of other STAMPs. In certain embodiments STAMP stability in solution was improved by inclusion of fluoride in mouthrinse.

Example 5

Photodynamic Therapy Targeted Against *Streptococcus mutans*

Dental caries (tooth decay) is one of the most prevalent and costly infectious diseases in the United States. Currently, the annual expenditures on dental services exceed $85 billion, with the majority of these costs attributable to dental caries and its sequelae (www.ada.org/). The oral cavity harbors a complex microbial community consisting of over 600 different non-harmful/commensal microbial species together with a limited number of pathogenic bacteria, including the major etiological agent of dental caries, *Streptococcus mutans*. Once established, *S. mutans* generates acid during the fermentation of dietary sugars, which causes the demineralization of tooth structure and inhibits the growth of non-pathogenic commensal bacteria within the same microbial niche. Despite diligent use of broad-spectrum antimicrobial compounds and tooth brushing, *S. mutans* persists within the oral cavity and causes repeated cycles of cariogenesis. Current "remove all, kill-all" approaches have shown limited efficacy, since a "cleaned" tooth surface provides an equal opportunity for commensal as well as pathogenic bacteria to re-colonize in the non-sterile environment of the oral cavity. To address this shortcoming, we have constructed and evaluated a light-activated *S. mutans-selective* antimicrobial agent. C16-RB, constructed via conjugation of the *S. mutans* competence-stimulating peptide to the photodynamic dye rose bengal, displays robust anti-*S. mutans* activity in vitro under blue exposure from a handheld dental curing light. C16-RB has reduced activity against other oral streptococci under mixed biofilm conditions and has limited cytotoxicity in vitro.

To develop a method of selectively eliminating *S. mutans* from a dental biofilm so that beneficial species exert a protective colonization effect and long-term protection from *S. mutans* re-colonization can be attained we created a novel class of targeted antimicrobials, known as specifically-targeted antimicrobial peptides, or STAMPs. STAMPs consist of functionally independent, yet conjoined, domains within a linear peptide sequence; a targeting region and an antimicrobial region. The targeting region, which binds specifically to a bacterial species of interest, delivers the killing portion of the molecule that consists of a normally wide-spectrum antimicrobial peptide. Previously, we successfully designed STAMPs against *S. mutans* by taking advantage of the competence stimulating pheromone (CSP) peptide produced by this organism that has demonstrated *S. mutans*-specific recognition. STAMPs synthesized with portions of CSP as targeting domains were capable of specific antimicrobial activity against *S. mutans*, and not other oral streptococci or non-cariogenic organisms in biofilms.

We hypothesized that targeted killing might be achieved through the use of non-peptide antimicrobial molecules, such as porphyrins or dyes utilized in PDT. Here we present the proof-of-principle construction and in vitro efficacy of the targeted, peptide-guided, photodynamic molecule C16-RB. C16-RB displays *S. mutans* selective antimicrobial activity upon blue light activation with limited activity against non-cariogenic oral streptococci and epithelial cells.

Materials and Methods

Synthesis of C16-RB

Figure 19A:
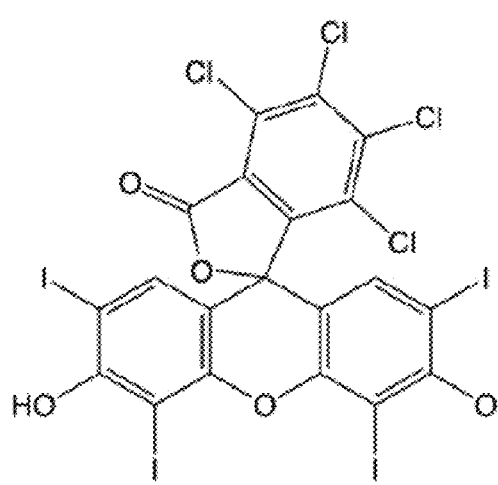
FIGS. 19A and 19B illustrate Rose Bengal (FIG. 19A) and synthesis scheme for C16-RB, halides and side-chains omitted for clarity (FIG. 19B).
Figure 19B:
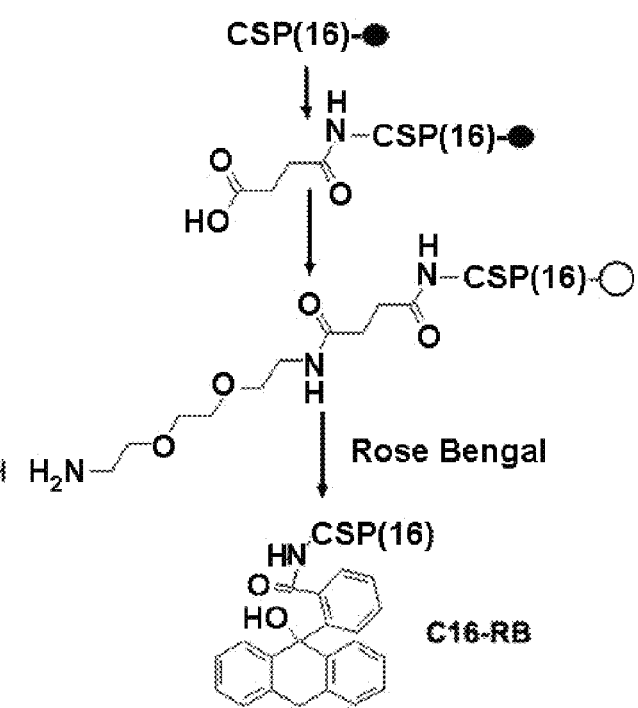

All amino acids, synthesis resins and reagents were peptide synthesis grade (Anaspec, San Jose, Calif.; Fisher Scientific). To construct our C16-RB conjugate, conventional 9-fluorenylmethoxy carbonyl (Fmoc) solid-phase methodology was employed to synthesize the $CSP_{c16}$ peptide and attach the succinate and PEG linkers, utilizing double coupling cycles in N-hdroxybenzotrazole, HBTU (O-benzotriazole-N,N,N,N-tetramethyluronium hexafluoro-phosphate) and diisopropyl ethylamine (DIEA), with dimethylformamide (DMF) and N-methylpyrrolidone (NMP) as solvents, as described previously. The peptide resin (1 molar equivalent, 15 mg) was then swollen in DMF for 30 min prior to attachment of the PEG terminal amide group to the carboxyl lactone in RB (FIG. 19B). This reaction was carried out in a mixture of 2-(7-Aza-1H-benzotriazole-1-yl)-1,1,3,3-tetramethyluronium hexafluorophosphate (HATU, 5-molar excess) in dichloromethane (DCM):DMF:dimethylsulphoxide (DMSO) (1:1:1 (v/v)). Ten molar equivalents of DIEA were added to the reaction flask to initiate the reaction, which was protected with argon and stirred at room temperature for 5 h. After completion, the reaction mixture was passed down sintered glass filtered vial and extensively washed with DMF and DCM to remove all waste reagents. The resin was then dried overnight in vacuum, and cleaved with 1 mL of trifluoroacetic acid (TFA)/thioanisole/water/EDT (10/0.5/0.5/025) for 2 hr at room temperature. The cleavage solution was precipitated with 10 mL methyl-tert butyl ether, and the precipitate was washed twice with the same amount of ether. The crude product was purified via preparative-level HPLC (Source 15RPC column, ACTA purifier, Amersham) and eluted with gradient acetonitrile/water from 10 to 35% in 10 min, which was increased to 90% over 8 min before finally being washed 15 min with 95% acetonitrile.

C16-RB was purified further to >90% and the molecular mass confirmed via LC/MS, utilizing increasing hydrophobicity gradient of acetonitrile in water with 0.01% TFA as described above (Waters X-bridge BEH 130 C18 column, 4.6×100 mm, particle size 5 μm, Waters 3100 system). LC spectra were analyzed with MassLynx Softward v. 4.1 (Waters). C16-RB mass (3118.0) was confirmed by electrospray ionization (ESI) mass spectroscopy in linear, positive ion mode. The final product was lyophilized and protected from light at all times. C16-RB was soluble in 50% methanol.

Bacterial and Cellular Growth

*Streptococcus oralis* ATCC10557, *Streptococcus gordonii* (Challis), *Streptococcus sanguinis* (NY101), *Streptococcus mitis* ATCC903, *Streptococcus salivarius* ATCC13419 and *S. mutans* wild-type UA140 and JM11 (spectinomycin-resistant) strains were grown in Todd-Hewitt (TH) broth 37° C. in an anaerobic atmosphere of 80% $N_2$, 10% $CO_2$, and 10% $H_2$. BHK-21 (ATCC CRL-10) fibroblasts were propagated in DMEM with 10% FBS, 1 mM sodium pyruvate, 100 units/mL penicillin G, and 100 μg/mL streptomycin at 37° C. with 5% $CO_2$. Cells were detached with 0.25% trypsin and subcultured as recommended by the supplier.

Photodynamic Antimicrobial Assays Against Biofilms

To evaluate C16-RB against monoculture biofilms, *S. mutans* UA140 was grown overnight in TH prior to inoculation for biofilm formation. For biofilms, 1:5000 dilution of overnight culture was made into TH with 1% sucrose in 2 mL centrifuge tubes (200 μL volume) and grown 24 h under anaerobic conditions. After incubation, biofilms were treated for 5 min with 5 or 25 μM C16-RB or 5 μM RB in 1×PBS, or PBS alone, followed by removal of supernatant and exposure to 5 min blue light (emission 400-550 nm, power 400 mW/cm$^2$) from an Astralis 7 (Ivoclar Vivodent, Austria) handheld LED commonly used as a dental curing light. The light source was suspended 4 cm from the tube bottom (even with the mouth of the tube). A duplicate set of samples were left covered to serve as dark controls. After treatment, biofilms were mechanically disrupted and plated to determine cfu/mL.

To gauge C16-RB selectivity for *S. mutans*, similar assays were conducted against multispecies biofilms. Mixed biofilms were seeded by diluting (1:5000) a mixture of equal parts *S. oralis, S. gordonii, S. mitis, S. sanguinis, S. salivarius*, and *S. mutans* JM11 (made from overnight cultures) into TH with 1% sucrose, 1% glucose, and 1% mannose. Biofilms were incubated and treated as described above with the addition of vitamin C or potassium gluconate. After the addition of agent and 5 min incubation, biofilms were washed 1× with 1×PBS prior to light exposure. After PDT and biofilm disruption, survivors were plated on TH, and TH supplemented with 800 μg/mL spectinomycin, which allowed for quantitation of surviving total oral streptococci and surviving *S. mutans*, respectively.

Evaluation of C16-RB Cytotoxicity

The effect of RB and C16-RB on human fibroblasts was ascertained by utilizing the Promega CellTiterGlo assay, as described by the manufacturer. Briefly, fibroblasts were grown to confluence, detached, and seeded to 5,000 cells per well in a 96-well opaque walled, clear bottom 96-well plate (Nunc International). For long-term dark toxicity, cells were allowed to attach to for 18 h before the culture medium was replaced with medium plus serially-diluted RB or C16-RB (200 μM to 390 nM) or medium alone. After 18-24 h, equal volume Cell Titer Glo reagent was added to each well and mixed. Luciferace activity was then quantified to measure cell viability (Varian Fluorometer in Biolumenescence mode). To measure cytotoxicity after RB or C16-RB light exposure, cells were seeded at ~10,000 cells per well and allowed to attach for 4 h. Cell growth medium was then replaced with RB or C16-RB containing medium, prior to exposure (a single well at a time) with blue light (400 mW/cm$^2$) suspended ~3 cm from the well bottom. After exposure, cultures were disrupted with Cell Titer Glo and luciferase activity quantitated as above.

Results

Design of Photodynamic Peptide-Dye Conjugate

For the targeting peptide component of the chimeric molecule, we selected a shortened derivative of S. mutans CSP, $CSP_{c16}$ (sequence: TFFRLFNRSFTQALGK). $CSP_{C16}$ has been utilized successfully as a STAMP targeting peptide in several constructs, and demonstrates selective binding to S. mutans and not other non-cariogenic bacteria. For the photodynamic dye, we selected rose bengal (RB, FIG. 19A), a xanthene dye with a demonstrated record of safety as a diagnostic tool in optometry. Unlike TBO or methylene blue, RB is not recognized by efflux pumps, and has shown robust activity against a variety of bacteria in vitro in the presence of green or blue light (max absorption ~549 nm), and can be activated by a handheld dental curing LED.

C16-RB Synthesis

Figure 20:
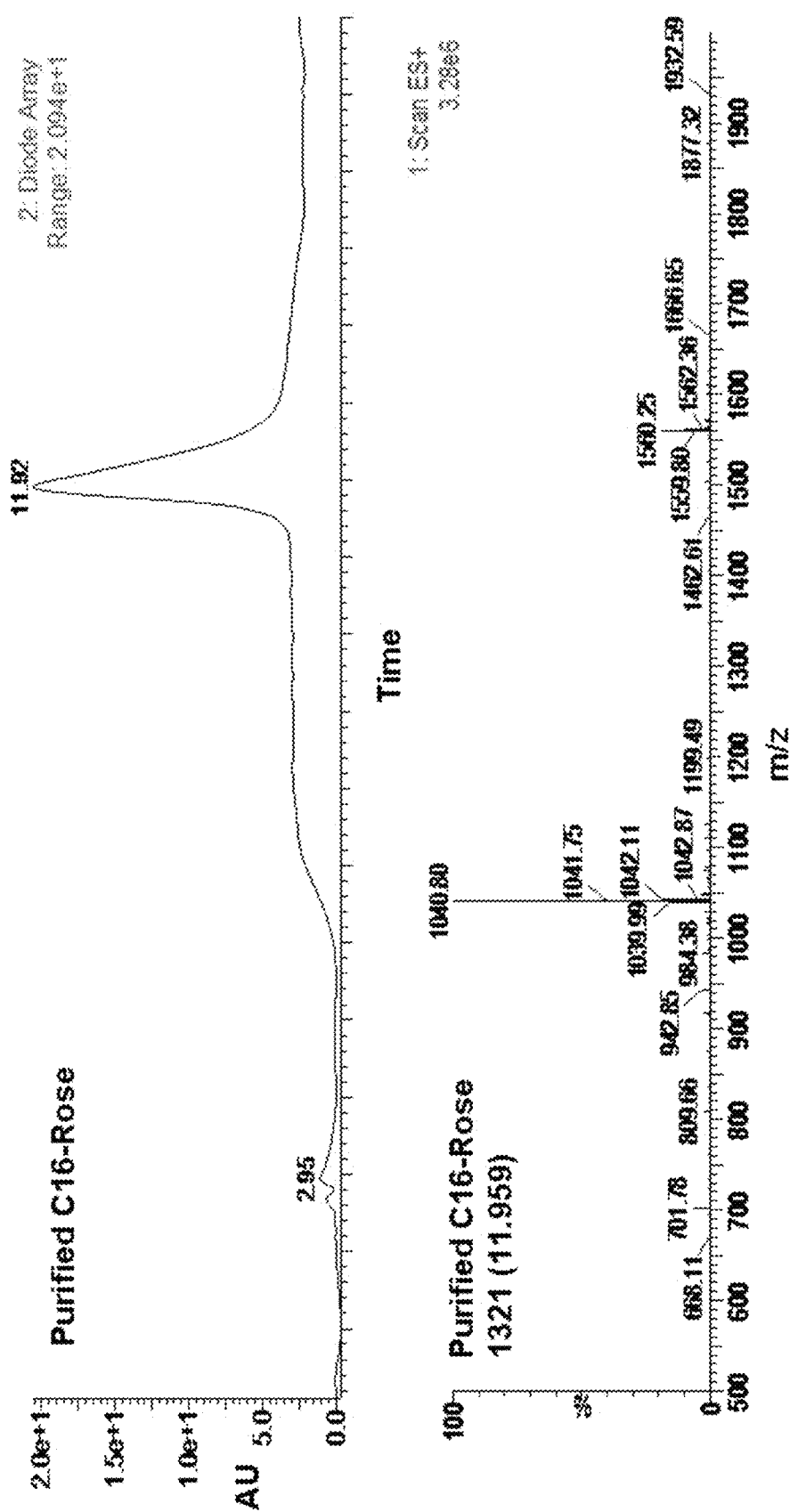
FIG. 20 shows LC/MS profile C16-RB. Purity and molecular mass of C16-RB was confirmed by LC/MS. A single product was observed at 11.92 min with mass species at 1040.8 and 1560.25 daltons. Expected C16-RB mas: m/z=3118, $m^{2+}/z=1559$, $m^{3+}/Z=1039$.

As shown in FIG. 19B, RB was attached to the N-terminus of $CSP_{c16}$ through a succinate/PEG linker to construct the C16-RB molecule. Conventional solid-phase peptide methods were utilized to synthesize $CSPC_{16}$, followed by linker and RB coupling prior to cleavage from the resin. After cleavage, C16-RB was repeatedly purified by LC/MS prior to evaluation. As shown in FIG. 20, over 95% purity was achieved with the expected mass species observed. The lactone ring in RB was opened as a result of $CSP_{C16}$ attachment. However, we hypothesized that the conjugate would retain enough singlet-oxygen generating activity for a proof-of-principle demonstration, as other xanthene dyes with activity lack this ring.

C16-RB Efficacy Against Single-Species S. mutans Biofilms

Figure 21:
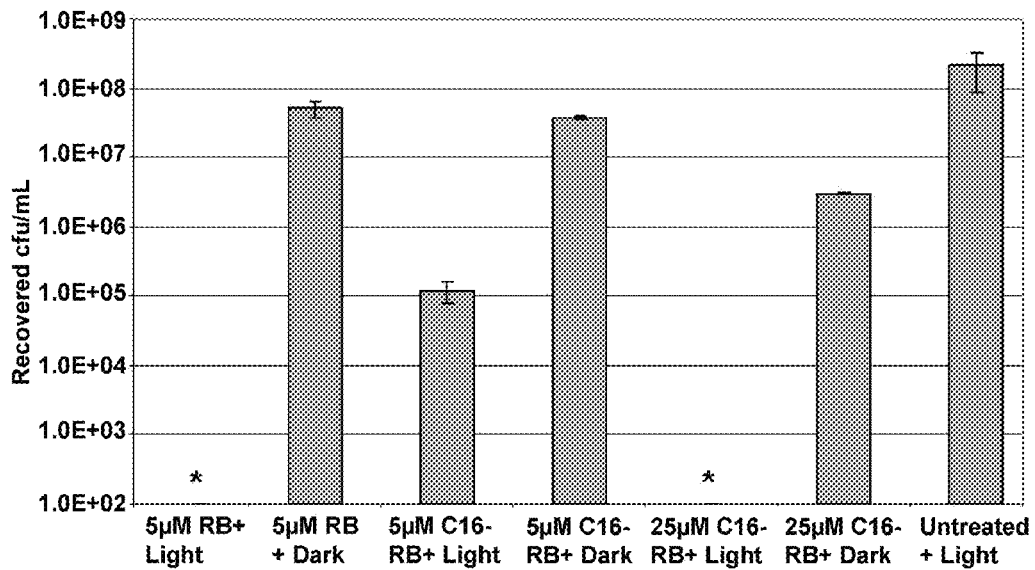
FIG. 21 illustrates activity of RB and C16-RB against single-species S. mutans biofilms. * indicates fewer than 100 cfu/mL recovered
Figure 22:
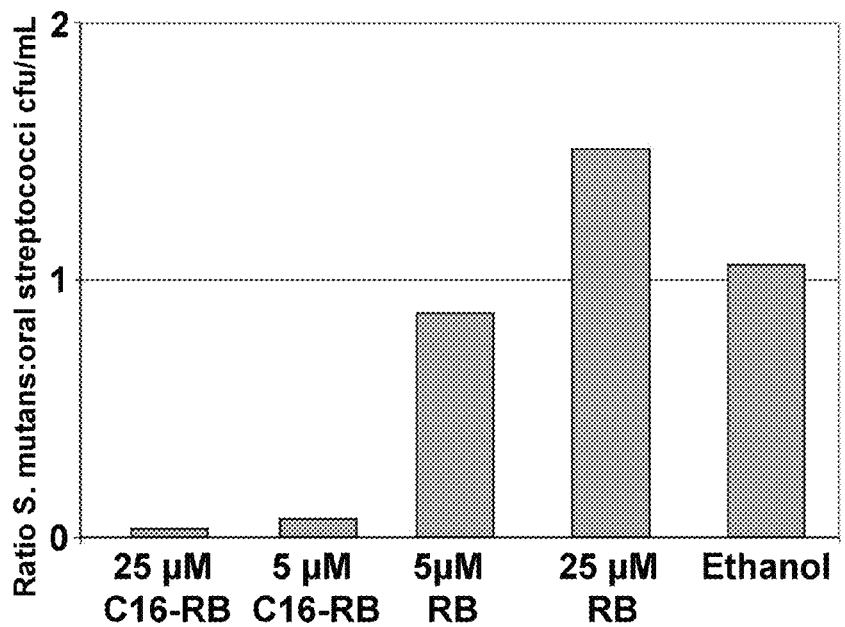
FIG. 22 shows S. mutans-specific C16-RB activity. C16-RB, and not RB alone, preferentially eliminated S. mutans, and not other oral streptococci, after blue light illumination.

After synthesis, the basic photosensitization potential of C16-RB was assessed by challenging mature single-species S. mutans biofilms (grown 24 h) with C16-RB or unmodified RB, followed by blue emission from a dental curing light. As shown in FIG. 21, potent antimicrobial activity was observed in cultures exposed to C16-RB or RB and blue light: a reduction in over 3 $log_{10}$ from input cfu/mL at 5 or 25 µM. In contrast, appreciable decreases in cfu/mL were not observed in S. mutans treated with blue light alone, or 5 µM RB or C16-RB dark controls. Modest dark toxicity was observed in samples treated with 25 µM C16-RB. Overall, these results indicate that the peptide-dye conjugate is active against S. mutans and at roughly similar levels to the parental RB molecule.

Selective PDT Against Multi-Species Biofilms

C16-RB was next evaluated for selectivity in mixed cultures containing S. mutans and non-cariogenic oral streptococci that compete for the same niche on the tooth surface. We utilized mixed biofilms of S. mutans transformed with spectinomycin resistance (strain JM11, Merritt, et al., 2005), plus S. oralis, S. gordonii, S. mitis, S. sanguinis, and S. salivarius. The mixed cultures were grown 24 and then treated with RB or C16-RB as indicated, plus potassium gluconate to minimize killing of untargeted bacteria by reducing the superoxide-producing activity of the free C16-RB not bound to S. mutans. Ethanol treatment served as an indiscriminant killing control. As shown in FIG. 21, RB alone exhibited strong indiscriminant photodynamic antimicrobial effects against S. mutans and non-S. mutans in the mixed biofilm system (ratio of surviving S. mutans:non-cariogenic streptococci cfu ~1). In contrast, C16-RB displayed specific photodynamic activity towards S. mutans, and not the other oral streptococci examined, as reflected in the low ratio of recovered S. mutans to other streptococci. These results suggest C16-RB has antimicrobial activity in the presence of blue light that is specific for S. mutans and dependent on the $CSP_{c16}$ targeting peptide.

Cytotoxicity Against Eukaryotic Cells

Given the demonstrated PDT potential of RB-C16, experiments were conducted to examine the cytotoxicity for this conjugate and RB alone. $IC_{50}$s were obtained for BHK cells exposed C16-RB, RB, or Melittin B (positive control for cytotoxicity), with and without blue light exposure. As shown in Table 23, cytotoxicity was noted for cells exposed to Melittin B at the lowest peptide dilution tested at either 5 min or 24 h, with or without light ($IC_{50}$<1.56 µM), while light-dependent toxicity was observed only for RB-treated samples. No photo-associated toxicity was noted in BHK cells treated with C16-RB, though modest light-independent cytotoxicity ($IC_{50}$=90 µM) was detected after 24 h of exposure. These results suggest that C16-RB is not toxic to BHK cells after illumination, and displays mild toxic effects (when compared to Melittin B) after 24 h exposure.

TABLE 23

Cytotoxicity of RB and C16-RB compounds.

| | $IC_{50}$ (µM) BHK |
|---|---|
| 5 min dark: | |
| RB-C16 | >100 |
| RB | >100 |
| Melittin B | <1.56 |
| 5 min w/blue light: | |
| RB-C16 | >100 |
| RB | 40 |
| Melittin B | <1.56 |
| 24 h dark | |
| RB-C16 | 55 |
| RB | 90 |
| Melittin B | <1.56 |

It is understood that the examples and embodiments described herein are for illustrative purposes only and that various modifications or changes in light thereof will be suggested to persons skilled in the art and are to be included within the spirit and purview of this application and scope of the appended claims. All publications, patents, and patent applications cited herein are hereby incorporated by reference in their entirety for all purposes.

SEQUENCE LISTING (3238 sequences)

SEQ ID NO: 1 - protein, 16 aa, Artificial
  Peptide with targeting and/or antimicrobial activity
TFFRLFNRSFTQALGK

SEQ ID NO: 2 - protein, 35 aa, Artificial
  Peptide with targeting and/or antimicrobial activity
TFFRLFNRSFTQALGKGGGKNLRIIRKGIHIIKKY

SEQ ID NO: 3 - protein, 16 aa, Artificial
  Peptide with targeting and/or antimicrobial activity
TFFRLFNRSFTQALGK

SEQ ID NO: 4 - protein, 12 aa, Artificial
  Peptide with targeting and/or antimicrobial activity
TFFRFLNRGGGK

SEQ ID NO: 5 - protein, 11 aa, Artificial
  Peptide with targeting and/or antimicrobial activity
FIRKFLKKWLL

SEQ ID NO: 6 - protein, 15 aa, Artificial
  Peptide with targeting and/or antimicrobial activity
KKHRKHRKHRKHGGG

SEQ ID NO: 7 - protein, 10 aa, Artificial
  Peptide with targeting and/or antimicrobial activity
DAANEAGGGK

SEQ ID NO: 8 - protein, 11 aa, Artificial
  Peptide with targeting and/or antimicrobial activity
FIRKFLKKWLL

SEQ ID NO: 9 - protein, 15 aa, Artificial
  Peptide with targeting and/or antimicrobial activity
KKHRKHRKHRKHGGG

SEQ ID NO: 10 - protein, 12 aa, Artificial
  Peptide with targeting and/or antimicrobial activity
TFFRFLNRGGGK

SEQ ID NO: 11 - protein, 11 aa, Artificial
  Peptide with targeting and/or antimicrobial activity
FIRKFLKKWLL

SEQ ID NO: 12 - protein, 9 aa, Artificial
  Peptide with targeting and/or antimicrobial activity
DAANEAGGG

SEQ ID NO: 13 - protein, 18 aa, Artificial
  Peptide with targeting and/or antimicrobial activity
VLGIAGGLDAYGELVGGN

SEQ ID NO: 14 - protein, 11 aa, Artificial
  Peptide with targeting and/or antimicrobial activity
LDAYGELVGGN

SEQ ID NO: 15 - protein, 15 aa, Artificial
  Peptide with targeting and/or antimicrobial activity
KFINGVLSQFVLERK

SEQ ID NO: 16 - protein, 20 aa, Artificial
  Peptide with targeting and/or antimicrobial activity
SQRIIEPVKSPQPYPGFSVS

SEQ ID NO: 17 - protein, 22 aa, Artificial
  Peptide with targeting and/or antimicrobial activity
FSVAACGEQRAVTFVLLIEDLI

SEQ ID NO: 18 - protein, 29 aa, Artificial
  Peptide with targeting and/or antimicrobial activity
WAWAESPRCVSTRSNIHALAFRVEVAALT

SEQ ID NO: 19 - protein, 12 aa, Artificial
  Peptide with targeting and/or antimicrobial activity
SPAGLPGDGDEA

SEQ ID NO: 20 - protein, 4 aa, Artificial
  Peptide with targeting and/or antimicrobial activity
RISE

SEQ ID NO: 21 - protein, 22 aa, Artificial
  Peptide with targeting and/or antimicrobial activity
FGNIFKGLKDVIETIVKWTAAK

SEQ ID NO: 22 - protein, 20 aa, Artificial
  Peptide with targeting and/or antimicrobial activity
FRSPCINNNSLQPPGVYPAR

SEQ ID NO: 23 - protein, 12 aa, Artificial
  Peptide with targeting and/or antimicrobial activity
ALAGLAGLISGK

SEQ ID NO: 24 - protein, 9 aa, Artificial
  Peptide with targeting and/or antimicrobial activity
DVILRVEAQ

SEQ ID NO: 25 - protein, 4 aa, Artificial
  Peptide with targeting and/or antimicrobial activity
IDMR

SEQ ID NO: 26 - protein, 8 aa, Artificial
  Peptide with targeting and/or antimicrobial activity
NNAIVYIS

SEQ ID NO: 27 - protein, 9 aa, Artificial
  Peptide with targeting and/or antimicrobial activity
YSKTLHFAD

SEQ ID NO: 28 - protein, 12 aa, Artificial
  Peptide with targeting and/or antimicrobial activity
PGAFRNPQMPRG

SEQ ID NO: 29 - protein, 20 aa, Artificial
  Peptide with targeting and/or antimicrobial activity
PALVDLSNKEAVWAVLDDHS

SEQ ID NO: 30 - protein, 30 aa, Artificial
  Peptide with targeting and/or antimicrobial activity
YVEEAVRAALKKEARISTEDTPVNLPSFDC

SEQ ID NO: 31 - protein, 22 aa, Artificial
  Peptide with targeting and/or antimicrobial activity
VPLDDGTRRPEVARNRDKDRED

SEQ ID NO: 32 - protein, 20 aa, Artificial
  Peptide with targeting and/or antimicrobial activity
PALVDLSNKEAVWAVLDDHS

SEQ ID NO: 33 - protein, 19 aa, Artificial
  Peptide with targeting and/or antimicrobial activity
EEAEEKLAEVSQAVKRLVR

SEQ ID NO: 34 - protein, 26 aa, Artificial
  Peptide with targeting and/or antimicrobial activity
VGLDVSVLVLFFGLQLLSVLLGAMIR

SEQ ID NO: 35 - protein, 38 aa, Artificial
  Peptide with targeting and/or antimicrobial activity
LTILPTTFFAIIVPILAVAFIAYSGFKIKGIVEHKDQW

SEQ ID NO: 36 - protein, 27 aa, Artificial
  Peptide with targeting and/or antimicrobial activity
ALFVSLEQFLVVVAKSVFALCHSGTLS

SEQ ID NO: 37 - protein, 25 aa, Artificial
  Peptide with targeting and/or antimicrobial activity
VSRDEAMEFIDREWTTLQPAGKSHA

SEQ ID NO: 38 - protein, 32 aa, Artificial
  Peptide with targeting and/or antimicrobial activity
GSVIKKRRKRMSKKKHRKMLRRTRVQRRKLGK

SEQ ID NO: 39 - protein, 27 aa, Artificial
  Peptide with targeting and/or antimicrobial activity
GKAKPYQVRQVLRAVDKLETRRKKGGR

SEQ ID NO: 40 - protein, 18 aa, Artificial
  Peptide with targeting and/or antimicrobial activity
NATGTDIGEVTLTLGRFS

SEQ ID NO: 41 - protein, 20 aa, Artificial
  Peptide with targeting and/or antimicrobial activity
VSFLAGWLCLGLAAWRLGNA

SEQ ID NO: 42 - protein, 37 aa, Artificial
  Peptide with targeting and/or antimicrobial activity
VRTLTILVIFIFNYLKSISYKLKQPFENNLAQSMISI

SEQ ID NO: 43 - protein, 27 aa, Artificial
  Peptide with targeting and/or antimicrobial activity
AFWLNILLTLLGYIPGIVHAVYIIAKR

SEQ ID NO: 44 - protein, 36 aa, Artificial
  Peptide with targeting and/or antimicrobial activity
EICLTLVFPIRGSYSEAAKFPVPIHIVEDGTVELPK

SEQ ID NO: 45 - protein, 20 aa, Artificial
  Peptide with targeting and/or antimicrobial activity
VYRHLRFIDGKLVEIRLERK

SEQ ID NO: 46 - protein, 22 aa, Artificial
  Peptide with targeting and/or antimicrobial activity
YIVGALVILAVAGLIYSMLRKA

SEQ ID NO: 47 - protein, 18 aa, Artificial
  Peptide with targeting and/or antimicrobial activity
VMFVLTRGRSPRPMIPAY

SEQ ID NO: 48 - protein, 19 aa, Artificial
  Peptide with targeting and/or antimicrobial activity
FGFCVWMYQLLAGPPGPPA

SEQ ID NO: 49 - protein, 14 aa, Artificial
  Peptide with targeting and/or antimicrobial activity
QRVSLWSEVEHEFR

SEQ ID NO: 50 - protein, 23 aa, Artificial
  Peptide with targeting and/or antimicrobial activity
KRGSKIVIAIAVVLIVLAGVWVW

SEQ ID NO: 51 - protein, 28 aa, Artificial
  Peptide with targeting and/or antimicrobial activity
TVLDWLSLALATGLFVYLLVALLRADRA

SEQ ID NO: 52 - protein, 18 aa, Artificial
  Peptide with targeting and/or antimicrobial activity
DRCLSVLSWSPPKVSPLI

SEQ ID NO: 53 - protein, 17 aa, Artificial
  Peptide with targeting and/or antimicrobial activity
DPALADFAAGMRAQVRT

SEQ ID NO: 54 - protein, 22 aa, Artificial
  Peptide with targeting and/or antimicrobial activity
WTKPSFTDLRLGFEVTLYFANR

SEQ ID NO: 55 - protein, 17 aa, Artificial
  Peptide with targeting and/or antimicrobial activity
FSFKQRVMFRKEVERLR

SEQ ID NO: 56 - protein, 15 aa, Artificial
  Peptide with targeting and/or antimicrobial activity
VIKISVPGQVQMLIP

SEQ ID NO: 57 - protein, 26 aa, Artificial
  Peptide with targeting and/or antimicrobial activity
KLQVHHGRATHTLLLQPPLCAPGTIR

SEQ ID NO: 58 - protein, 25 aa, Artificial
  Peptide with targeting and/or antimicrobial activity
SLVRIHDQQPWVTRGAFIDAARTCS

SEQ ID NO: 59 - protein, 17 aa, Artificial
  Peptide with targeting and/or antimicrobial activity
HSDEPIPNILFKSDSVH

SEQ ID NO: 60 - protein, 22 aa, Artificial
  Peptide with targeting and/or antimicrobial activity
GKPKRMPAEFIDGYGQALLAGA

SEQ ID NO: 61 - protein, 20 aa, Artificial
  Peptide with targeting and/or antimicrobial activity
DEYPAKLPLSDKGATEPRRH

SEQ ID NO: 62 - protein, 26 aa, Artificial
  Peptide with targeting and/or antimicrobial activity
SDILAEMFEKGELQTLVKDAAAKANA

SEQ ID NO: 63 - protein, 12 aa, Artificial
  Peptide with targeting and/or antimicrobial activity
RWVSCNPSWRIQ

SEQ ID NO: 64 - protein, 25 aa, Artificial
  Peptide with targeting and/or antimicrobial activity
NHKTLKEWKAKWGPEAVESWATLLG

SEQ ID NO: 65 - protein, 14 aa, Artificial
  Peptide with targeting and/or antimicrobial activity
LALIGAGIWMIRKG

SEQ ID NO: 66 - protein, 24 aa, Artificial
  Peptide with targeting and/or antimicrobial activity
RLEYRRLETQVEENPESGRRPMRG

SEQ ID NO: 67 - protein, 19 aa, Artificial
  Peptide with targeting and/or antimicrobial activity
CDDLHALERAGKLDALLSA

SEQ ID NO: 68 - protein, 25 aa, Artificial
  Peptide with targeting and/or antimicrobial activity
AVGNNLGKDNDSGHRGKKHRKHKHR

SEQ ID NO: 69 - protein, 22 aa, Artificial
  Peptide with targeting and/or antimicrobial activity
YLTSLGLDAAEQAQGLLTILKG

SEQ ID NO: 70 - protein, 24 aa, Artificial
  Peptide with targeting and/or antimicrobial activity
HATLLPAVREAISRQLLPALVPRG

SEQ ID NO: 71 - protein, 21 aa, Artificial
  Peptide with targeting and/or antimicrobial activity
GCKGCAQRDPCAEPEPYFRLR

SEQ ID NO: 72 - protein, 22 aa, Artificial
  Peptide with targeting and/or antimicrobial activity
EPLILKELVRNLFLFCYARALR

SEQ ID NO: 73 - protein, 21 aa, Artificial
  Peptide with targeting and/or antimicrobial activity
QTVHHIHMHVLGQRQMHWPPG

SEQ ID NO: 74 - protein, 27 aa, Artificial
  Peptide with targeting and/or antimicrobial activity
HARAAVGVAELPRGAAVEVELIAAVRP

SEQ ID NO: 75 - protein, 27 aa, Artificial
  Peptide with targeting and/or antimicrobial activity
DTDCLSRAYAQRIDELDKQYAGIDKPL

SEQ ID NO: 76 - protein, 24 aa, Artificial
  Peptide with targeting and/or antimicrobial activity
GQRQRLTCGRVSGCSEGPSREAAR

SEQ ID NO: 77 - protein, 11 aa, Artificial
  Peptide with targeting and/or antimicrobial activity
GGTKEIVYQRG

SEQ ID NO: 78 - protein, 12 aa, Artificial
  Peptide with targeting and/or antimicrobial activity
ILSQEADRKKLF

SEQ ID NO: 79 - protein, 15 aa, Artificial
  Peptide with targeting and/or antimicrobial activity
NRQAQGERAHGEQQG

SEQ ID NO: 80 - protein, 13 aa, Artificial
  Peptide with targeting and/or antimicrobial activity
KIDTNQWPPNKEG

SEQ ID NO: 81 - protein, 11 aa, Artificial
  Peptide with targeting and/or antimicrobial activity
EPTDGVACKER

SEQ ID NO: 82 - protein, 27 aa, Artificial
  Peptide with targeting and/or antimicrobial activity
GWWEELLHETILSKFKITKALELPIQL

SEQ ID NO: 83 - protein, 26 aa, Artificial
  Peptide with targeting and/or antimicrobial activity
DIDWGRKISCAAGVAYGAIDGCATTV

SEQ ID NO: 84 - protein, 23 aa, Artificial
  Peptide with targeting and/or antimicrobial activity
GVARGLQLGIKTRTQWGAATGAA

SEQ ID NO: 85 - protein, 17 aa, Artificial
  Peptide with targeting and/or antimicrobial activity
EMRLSKFFRDFILWRKK

SEQ ID NO: 86 - protein, 17 aa, Artificial
  Peptide with targeting and/or antimicrobial activity
EMRISRIILDFLFLRKK

SEQ ID NO: 87 - protein, 28 aa, Artificial
  Peptide with targeting and/or antimicrobial activity
FFKTIFVLILGALGVAAGLYIEKNYIDK

SEQ ID NO: 88 - protein, 28 aa, Artificial
  Peptide with targeting and/or antimicrobial activity
FGTPWSITNFWKKNFNDRPDFDSDRRRY

SEQ ID NO: 89 - protein, 13 aa, Artificial
  Peptide with targeting and/or antimicrobial activity
GGNLGPGFGVIIP

SEQ ID NO: 90 - protein, 19 aa, Artificial
  Peptide with targeting and/or antimicrobial activity
AIATGLDIVDGKFDGYLWA

SEQ ID NO: 91 - protein, 28 aa, Artificial
  Peptide with targeting and/or antimicrobial activity
FGVGVGIALFMAGYAIGKDLRKKFGKSC

SEQ ID NO: 92 - protein, 31 aa, Artificial
  Peptide with targeting and/or antimicrobial activity
QKPRKNETFIGYIQRYDIDGNGYQSLPCPQN

SEQ ID NO: 93 - protein, 32 aa, Artificial
  Peptide with targeting and/or antimicrobial activity
FRKKRYGLSILLWLNAFTNLVNSIHAFYMTLF

SEQ ID NO: 94 - protein, 24 aa, Artificial
  Peptide with targeting and/or antimicrobial activity
VMASLTWRMRAASASLPTHSRTDA

SEQ ID NO: 95 - protein, 19 aa, Artificial
  Peptide with targeting and/or antimicrobial activity
HRKNPVLGVGRRHRAHNVA

SEQ ID NO: 96 - protein, 13 aa, Artificial
  Peptide with targeting and/or antimicrobial activity
EAVGQDLVDAHHP

SEQ ID NO: 97 - protein, 23 aa, Artificial
  Peptide with targeting and/or antimicrobial activity
HEDDKRRGMSVEVLGFEVVQHEE

SEQ ID NO: 98 - protein, 8 aa, Artificial
  Peptide with targeting and/or antimicrobial activity
RNVIGQVL

SEQ ID NO: 99 - protein, 27 aa, Artificial
  Peptide with targeting and/or antimicrobial activity
TSVRPGAAGAAVPAGAAGAAGAGWRWP

SEQ ID NO: 100 - protein, 19 aa, Artificial
  Peptide with targeting and/or antimicrobial activity
GQDEGQRRAGVGEGQGVDG

SEQ ID NO: 101 - protein, 8 aa, Artificial
  Peptide with targeting and/or antimicrobial activity
AMRSVNQA

SEQ ID NO: 102 - protein, 18 aa, Artificial
  Peptide with targeting and/or antimicrobial activity
DQVAHSGDMLVQARRRDS

SEQ ID NO: 103 - protein, 27 aa, Artificial
  Peptide with targeting and/or antimicrobial activity
GHLLRVGGRVGGVGGVAGACAQPFGGQ

SEQ ID NO: 104 - protein, 12 aa, Artificial
  Peptide with targeting and/or antimicrobial activity
VAGACAQPFGGQ

SEQ ID NO: 105 - protein, 32 aa, Artificial
  Peptide with targeting and/or antimicrobial activity
GVAERNLDRITVAVAIIWTITIVGLGLVAKLG

SEQ ID NO: 106 - protein, 32 aa, Artificial
  Peptide with targeting and/or antimicrobial activity
VRSAKAVKALTAAGYTGELVNVSGGMKAWLGQ

SEQ ID NO: 107 - protein, 7 aa, Artificial
  Peptide with targeting and/or antimicrobial activity
MKAWLGQ

SEQ ID NO: 108 - protein, 37 aa, Artificial
  Peptide with targeting and/or antimicrobial activity
LDPLEPRIAPPGDRSHQGAPACHRDPLRGRSARDAER

SEQ ID NO: 109 - protein, 29 aa, Artificial
  Peptide with targeting and/or antimicrobial activity
RLRVGRATDLPLTSFAVGVVRNLPDAPAH

SEQ ID NO: 110 - protein, 30 aa, Artificial
  Peptide with targeting and/or antimicrobial activity
WKRLWPARILAGHSRRRMRWMVVWRYFAAT

SEQ ID NO: 111 - protein, 22 aa, Artificial
  Peptide with targeting and/or antimicrobial activity
AQFYEAIITGYALGAGQRIGQL

SEQ ID NO: 112 - protein, 24 aa, Artificial
  Peptide with targeting and/or antimicrobial activity
RAVAAHLQGRHHGHQVRRQRHGQR

SEQ ID NO: 113 - protein, 19 aa, Artificial
  Peptide with targeting and/or antimicrobial activity
GEGLPPPVLHLPPPRMSGR

SEQ ID NO: 114 - protein, 14 aa, Artificial
  Peptide with targeting and/or antimicrobial activity
DALRRSRSQGRRHR

SEQ ID NO: 115 - protein, 17 aa, Artificial
  Peptide with targeting and/or antimicrobial activity
SPVPRFTAVGGVSRGSP

SEQ ID NO: 116 - protein, 11 aa, Artificial
  Peptide with targeting and/or antimicrobial activity
WGPLGPERPLW

SEQ ID NO: 117 - protein, 11 aa, Artificial
  Peptide with targeting and/or antimicrobial activity
VTTNVRQGAGS

SEQ ID NO: 118 - protein, 14 aa, Artificial
  Peptide with targeting and/or antimicrobial activity
LAAKTAVCVGRAFM

SEQ ID NO: 119 - protein, 26 aa, Artificial
  Peptide with targeting and/or antimicrobial activity
GRLSRREEDPATSIILLRGAYRMAVF

SEQ ID NO: 120 - protein, 13 aa, Artificial
  Peptide with targeting and/or antimicrobial activity
SDNDGKLILGTSQ

SEQ ID NO: 121 - protein, 36 aa, Artificial
  Peptide with targeting and/or antimicrobial activity
HGAHQRTGQRLHHHRGRTVSGCRQNPVAGVDPDEHR

SEQ ID NO: 122 - protein, 23 aa, Artificial
  Peptide with targeting and/or antimicrobial activity
RQAPGPGLVTITAACSAPGSRSR

SEQ ID NO: 123 - protein, 10 aa, Artificial
  Peptide with targeting and/or antimicrobial activity
LLIERFSNHH

SEQ ID NO: 124 - protein, 9 aa, Artificial
  Peptide with targeting and/or antimicrobial activity
MILHRRRDR

SEQ ID NO: 125 - protein, 20 aa, Artificial
  Peptide with targeting and/or antimicrobial activity
GPGVVGPAPFSRLPAHALNL

SEQ ID NO: 126 - protein, 32 aa, Artificial
  Peptide with targeting and/or antimicrobial activity
TASPPAPSDQGLRTAFPATLLIALAALARISR

SEQ ID NO: 127 - protein, 39 aa, Artificial
  Peptide with targeting and/or antimicrobial activity
SPATQKAPTRAQPSRAPVQDCGDGRPTAAPDDVERLSPR

SEQ ID NO: 128 - protein, 20 aa, Artificial
  Peptide with targeting and/or antimicrobial activity
DVRDRVDLAGADLCAAHATR

SEQ ID NO: 129 - protein, 28 aa, Artificial
  Peptide with targeting and/or antimicrobial activity
FAKETGFGIGGAQEGWWIIADIYGPNPF

SEQ ID NO: 130 - protein, 23 aa, Artificial
  Peptide with targeting and/or antimicrobial activity
GAIPDPVTHRVDWEEDHQTRPSR

SEQ ID NO: 131 - protein, 29 aa, Artificial
  Peptide with targeting and/or antimicrobial activity
LVRRNAVAGRSDGLAGAEQLDLVRLQGVL

SEQ ID NO: 132 - protein, 9 aa, Artificial
  Peptide with targeting and/or antimicrobial activity
LFDERNKIA

SEQ ID NO: 133 - protein, 18 aa, Artificial
  Peptide with targeting and/or antimicrobial activity
DAITGGNPPLSDTDGLRP

SEQ ID NO: 134 - protein, 13 aa, Artificial
  Peptide with targeting and/or antimicrobial activity
QGLARPVLRRIPL

SEQ ID NO: 135 - protein, 18 aa, Artificial
  Peptide with targeting and/or antimicrobial activity
YDPVPKRKNKNSEGKREE

SEQ ID NO: 136 - protein, 17 aa, Artificial
  Peptide with targeting and/or antimicrobial activity
SGSAIRMLEIATKMLKR

SEQ ID NO: 137 - protein, 19 aa, Artificial
  Peptide with targeting and/or antimicrobial activity
YDKYIKYLSIQPPFIVYFI

SEQ ID NO: 138 - protein, 56 aa, Artificial
  Peptide with targeting and/or antimicrobial activity
QKIIDMSKFLFSLILFIMIVVIYIGKSIGGYSAIVSSIMLELDTVLYNKKIFFIYK

SEQ ID NO: 139 - protein, 9 aa, Artificial
  Peptide with targeting and/or antimicrobial activity
DEVWKMLGI

SEQ ID NO: 140 - protein, 39 aa, Artificial
  Peptide with targeting and/or antimicrobial activity
YSKKLFEYFYFIIFILIRYLIFYKIIQNKNYYINNIAYN

SEQ ID NO: 141 - protein, 35 aa, Artificial
  Peptide with targeting and/or antimicrobial activity
YFIKDDNEALSKDWEVIGNDLKGTIDKYGKEFKVR

SEQ ID NO: 142 - protein, 14 aa, Artificial
  Peptide with targeting and/or antimicrobial activity
SRLVREIKKKCRKS

SEQ ID NO: 143 - protein, 24 aa, Artificial
  Peptide with targeting and/or antimicrobial activity
FESLLPQATKKIVNNKGSKINKIF

SEQ ID NO: 144 - protein, 17 aa, Artificial
  Peptide with targeting and/or antimicrobial activity
ELLTQIRLALLYSVNEW

SEQ ID NO: 145 - protein, 55 aa, Artificial
  Peptide with targeting and/or antimicrobial activity
PLNFYRAVKENRLPLSEKNINDFTNIKLKVSPKLINLLQESSIFYNFSPKKRNTN

SEQ ID NO: 146 - protein, 42 aa, Artificial
  Peptide with targeting and/or antimicrobial activity
YPNEYCIFLENLSLEELKEIKAINGETLNLEEIINERKNLKD

SEQ ID NO: 147 - protein, 39 aa, Artificial
  Peptide with targeting and/or antimicrobial activity
AVAGAAVGALLGNDARSTAVGAAIGGALGAGAGELTKNK

SEQ ID NO: 148 - protein, 39 aa, Artificial
  Peptide with targeting and/or antimicrobial activity
IKGTIAFVGEDYVEIRVDKGVKLTFRKSAIANVINNNQQ

SEQ ID NO: 149 - protein, 28 aa, Artificial
  Peptide with targeting and/or antimicrobial activity
KKFIILLFILVQGLIFSATKTLSDIIAL

SEQ ID NO: 150 - protein, 16 aa, Artificial
  Peptide with targeting and/or antimicrobial activity
FTQGIKRIVLKRLKED

SEQ ID NO: 151 - protein, 29 aa, Artificial
  Peptide with targeting and/or antimicrobial activity
MPKRHYYKLEAKALQFGLPFAYSPIQLLK

SEQ ID NO: 152 - protein, 18 aa, Artificial
  Peptide with targeting and/or antimicrobial activity
IIELHPKSWTQDWRCSFL

SEQ ID NO: 153 - protein, 39 aa, Artificial
  Peptide with targeting and/or antimicrobial activity
VEAGKRNISLENIEKISKGLGISISELFKYIEEGEDKIG

SEQ ID NO: 154 - protein, 31 aa, Artificial
  Peptide with targeting and/or antimicrobial activity
RNSADNQTKIDKIRIDISLWDEHLNIVKQGK

SEQ ID NO: 155 - protein, 30 aa, Artificial
  Peptide with targeting and/or antimicrobial activity
GVENRRFYERDVSKVSMMTSEAVAPRGGSK

SEQ ID NO: 156 - protein, 22 aa, Artificial
  Peptide with targeting and/or antimicrobial activity
IVELDDTTILERALSMLGEANA

SEQ ID NO: 157 - protein, 23 aa, Artificial
  Peptide with targeting and/or antimicrobial activity
SVRAVKPIDETVARHFPGDFIVN

SEQ ID NO: 158 - protein, 32 aa, Artificial
  Peptide with targeting and/or antimicrobial activity
YINRRLKKAFSDADIKEAPAEFYEELRRVQYV

SEQ ID NO: 159 - protein, 23 aa, Artificial
  Peptide with targeting and/or antimicrobial activity
SVRAVKPIDEIVAWHFPGDFIVN

SEQ ID NO: 160 - protein, 29 aa, Artificial
  Peptide with targeting and/or antimicrobial activity
YVSADESAYNHIVTDDIPLADRRIEAVQQ

SEQ ID NO: 161 - protein, 9 aa, Artificial
  Peptide with targeting and/or antimicrobial activity
YIACPGYFY

SEQ ID NO: 162 - protein, 13 aa, Artificial
  Peptide with targeting and/or antimicrobial activity
YFSFLEIVGMARR

SEQ ID NO: 163 - protein, 28 aa, Artificial
  Peptide with targeting and/or antimicrobial activity
LKLAFGVYPFQAMSQSDTAVSERNVLWR

SEQ ID NO: 164 - protein, 29 aa, Artificial
  Peptide with targeting and/or antimicrobial activity
GRFQISIRGEEKSKVKVQGKGTFTDRNTT

SEQ ID NO: 165 - protein, 30 aa, Artificial
  Peptide with targeting and/or antimicrobial activity
RRFRKTTENREKSKNKKAVLGLSTTSTASY

SEQ ID NO: 166 - protein, 29 aa, Artificial
  Peptide with targeting and/or antimicrobial activity
WENKPSPLGSIKKLQGLVYRLIGYRHFWV

SEQ ID NO: 167 - protein, 30 aa, Artificial
  Peptide with targeting and/or antimicrobial activity
IFSLHHFALICSEMGTFAVSKRAKYKWEVL

SEQ ID NO: 168 - protein, 11 aa, Artificial
  Peptide with targeting and/or antimicrobial activity
AQYKYINKLLN

SEQ ID NO: 169 - protein, 30 aa, Artificial
  Peptide with targeting and/or antimicrobial activity
NKVLQVEVMWDGSVVGRPAGVISIKSSKKG

SEQ ID NO: 170 - protein, 28 aa, Artificial
  Peptide with targeting and/or antimicrobial activity
QKAKEESDRKAAVSYNGFHRVNVVSIPK

SEQ ID NO: 171 - protein, 31 aa, Artificial
  Peptide with targeting and/or antimicrobial activity
MENILIYIPMVLSPFGSGILLFLGKDRRYML

SEQ ID NO: 172 - protein, 29 aa, Artificial
  Peptide with targeting and/or antimicrobial activity
KKSHSQGKRKLKDLNSAYKIDNQLHYALR

SEQ ID NO: 173 - protein, 23 aa, Artificial
  Peptide with targeting and/or antimicrobial activity
CYDSFDFSIFVTFANRMKLSVGS

SEQ ID NO: 174 - protein, 17 aa, Artificial
  Peptide with targeting and/or antimicrobial activity
AQSAGQIKRKSKVRIHV

SEQ ID NO: 175 - protein, 35 aa, Artificial
  Peptide with targeting and/or antimicrobial activity
SRMSEHSPAGLVFEVGPMDKGSFIILDSYHPTVKK

SEQ ID NO: 176 - protein, 41 aa, Artificial
  Peptide with targeting and/or antimicrobial activity
ELHRIMSTEKIGAVTKMNFDTAPIMSILPIDIYPKEVGIGS

SEQ ID NO: 177 - protein, 31 aa, Artificial
  Peptide with targeting and/or antimicrobial activity
FARVRRLHQNRILTQPLTNLKYCLRQPIYSD

SEQ ID NO: 178 - protein, 30 aa, Artificial
  Peptide with targeting and/or antimicrobial activity
AYGKVFSMDIMLSENDKLIVLRISHHSAWH

SEQ ID NO: 179 - protein, 23 aa, Artificial
  Peptide with targeting and/or antimicrobial activity
SVRAVKPIDKTVARHFPGDFIVN

SEQ ID NO: 180 - protein, 13 aa, Artificial
  Peptide with targeting and/or antimicrobial activity
FEGLKNLLGDDII

SEQ ID NO: 181 - protein, 12 aa, Artificial
  Peptide with targeting and/or antimicrobial activity
LFRKEDQEHVLL

SEQ ID NO: 182 - protein, 21 aa, Artificial
  Peptide with targeting and/or antimicrobial activity
SGGSDTDGSSSGEPGSHSGDL

SEQ ID NO: 183 - protein, 10 aa, Artificial
  Peptide with targeting and/or antimicrobial activity
GEPGSHSGDL

SEQ ID NO: 184 - protein, 27 aa, Artificial
  Peptide with targeting and/or antimicrobial activity
PVGDIMSGFLRGANQPRFLLDHISFGS

SEQ ID NO: 185 - protein, 26 aa, Artificial
  Peptide with targeting and/or antimicrobial activity
GTNVPTQILGYSREERFDYEPAPEQR

SEQ ID NO: 186 - protein, 27 aa, Artificial
  Peptide with targeting and/or antimicrobial activity
LLASHPERLSLGVFFVYRVLHLLLENT

SEQ ID NO: 187 - protein, 16 aa, Artificial
  Peptide with targeting and/or antimicrobial activity
TCYPLIQRKTDRAYEA

SEQ ID NO: 188 - protein, 10 aa, Artificial
  Peptide with targeting and/or antimicrobial activity
VVFGGGDRLV

SEQ ID NO: 189 - protein, 7 aa, Artificial
  Peptide with targeting and/or antimicrobial activity
YGKESDP

SEQ ID NO: 190 - protein, 18 aa, Artificial
  Peptide with targeting and/or antimicrobial activity
LTASICRQWNDNSTPYQR

SEQ ID NO: 191 - protein, 27 aa, Artificial
  Peptide with targeting and/or antimicrobial activity
PLRSFVAEKAEHAFRVVRIADFDFGHS

SEQ ID NO: 192 - protein, 18 aa, Artificial
  Peptide with targeting and/or antimicrobial activity
ALLVLNLLLMQFFFGKNM

SEQ ID NO: 193 - protein, 17 aa, Artificial
  Peptide with targeting and/or antimicrobial activity
HYHFLLEFGFHKGDYLE

SEQ ID NO: 194 - protein, 8 aa, Artificial
  Peptide with targeting and/or antimicrobial activity
HRKDVYKK

SEQ ID NO: 195 - protein, 41 aa, Artificial
  Peptide with targeting and/or antimicrobial activity
IQIIVNAFVEKDKTGAVIEVLYASNNHEKVKAKYEELVAIS

SEQ ID NO: 196 - protein, 17 aa, Artificial
  Peptide with targeting and/or antimicrobial activity
ILVLLALQVELDSKFQY

SEQ ID NO: 197 - protein, 25 aa, Artificial
  Peptide with targeting and/or antimicrobial activity
LMIFDKHANLKYKYGNRSFGVEAIM

SEQ ID NO: 198 - protein, 17 aa, Artificial
  Peptide with targeting and/or antimicrobial activity
AASGFTYCASNGVWHPY

SEQ ID NO: 199 - protein, 32 aa, Artificial
  Peptide with targeting and/or antimicrobial activity
KPEKEKLDTNTLMKVVNKALSLFDRLLIKFGA

SEQ ID NO: 200 - protein, 41 aa, Artificial
  Peptide with targeting and/or antimicrobial activity
TEILNFLITVCADRENWKIKHGLSDSVLLIFFARFTGAEYW

SEQ ID NO: 201 - protein, 51 aa, Artificial
  Peptide with targeting and/or antimicrobial activity
MPVSKKRYMLSSAYATALGICYGQVATDEKESEITAIPDLLDYLSVEEYLL

SEQ ID NO: 202 - protein, 18 aa, Artificial
  Peptide with targeting and/or antimicrobial activity
RAGRIKKLSQKEAEPFEN

SEQ ID NO: 203 - protein, 42 aa, Artificial
  Peptide with targeting and/or antimicrobial activity
MRFKRFDRDYALSGDNVFEVLTASCDVIERNLSYREMCGLMQ

SEQ ID NO: 204 - protein, 18 aa, Artificial
  Peptide with targeting and/or antimicrobial activity
KRKHENVIVAEEMRVIKN

SEQ ID NO: 205 - protein, 41 aa, Artificial
  Peptide with targeting and/or antimicrobial activity
LCRLEKLCKQFLRQDKVVTYYLMLPYKRAIEAFYQELKERS

SEQ ID NO: 206 - protein, 37 aa, Artificial
  Peptide with targeting and/or antimicrobial activity
YPFCLATVDHLPEGLSVTDYERVQRLVSQFLLNKEER

SEQ ID NO: 207 - protein, 30 aa, Artificial
  Peptide with targeting and/or antimicrobial activity
SPLEKYGTGSMTALTFLLGCCLLVLSKKSR

SEQ ID NO: 208 - protein, 25 aa, Artificial
  Peptide with targeting and/or antimicrobial activity
KRKRWAILTLFLAGLGAVGIVLATF

SEQ ID NO: 209 - protein, 34 aa, Artificial
  Peptide with targeting and/or antimicrobial activity
VCFKDISVFLSPFRGQEVLFCGKAKHSLIYVIGT

SEQ ID NO: 210 - protein, 13 aa, Artificial
  Peptide with targeting and/or antimicrobial activity
FFLNVIAIRIPHF

SEQ ID NO: 211 - protein, 35 aa, Artificial
  Peptide with targeting and/or antimicrobial activity
MLSNVLSRSVVSPNVDIPNSMVILSPLLISISNYH

SEQ ID NO: 212 - protein, 22 aa, Artificial
  Peptide with targeting and/or antimicrobial activity
KLIFAALGLVFLLIGLRDSRSK

SEQ ID NO: 213 - protein, 16 aa, Artificial
  Peptide with targeting and/or antimicrobial activity
RNINVSATFITEKSLV

SEQ ID NO: 214 - protein, 37 aa, Artificial
  Peptide with targeting and/or antimicrobial activity
DIGRIIGKKGRTITAIRSIVYSVPTQGKKVRLVIDEK

SEQ ID NO: 215 - protein, 24 aa, Artificial
  Peptide with targeting and/or antimicrobial activity
RIEASLISAIMFSMFNAIVKFLQK

SEQ ID NO: 216 - protein, 40 aa, Artificial
  Peptide with targeting and/or antimicrobial activity
NQKMEINSMTSEKEKMLAGHFHNEANFAVIFKYSLFYNFF

SEQ ID NO: 217 - protein, 38 aa, Artificial
  Peptide with targeting and/or antimicrobial activity
RRSLGNSASFAEWIEYIRYLHYIIRVQFIHFFSKNKKI

SEQ ID NO: 218 - protein, 38 aa, Artificial
  Peptide with targeting and/or antimicrobial activity
KLQEKQIDRNFERVSGYSTYRAVQAAKAKEKGFISLEN

SEQ ID NO: 219 - protein, 44 aa, Artificial
  Peptide with targeting and/or antimicrobial activity
IFKLFEEHLLYLLDAFYYSKIFRRLKQGLYRRKEQPYTQDLFRM

SEQ ID NO: 220 - protein, 41 aa, Artificial
  Peptide with targeting and/or antimicrobial activity
EFLEKFKVLKQPRKANNISKNRVAMIFLTIHKSRGFLSSPY

SEQ ID NO: 221 - protein, 41 aa, Artificial
  Peptide with targeting and/or antimicrobial activity
TDQELEHLIVTELESKRLDFTYSKDITEFFDEAFPEYDQNY

SEQ ID NO: 222 - protein, 41 aa, Artificial
  Peptide with targeting and/or antimicrobial activity
DNFYLILKMEERGKSKKTSQTRGFRAFFDIIRKKIKKEDGK

SEQ ID NO: 223 - protein, 21 aa, Artificial
  Peptide with targeting and/or antimicrobial activity
EDPVPNHFTLRRNKKEKPSKS

SEQ ID NO: 224 - protein, 35 aa, Artificial
  Peptide with targeting and/or antimicrobial activity
IFNRRKFFQYFGLSKEAMVEHIQPFILDIWQIHLF

SEQ ID NO: 225 - protein, 29 aa, Artificial
  Peptide with targeting and/or antimicrobial activity
ADDLLNKRLTDLIMENAETVKTIDLDNSD

SEQ ID NO: 226 - protein, 40 aa, Artificial
  Peptide with targeting and/or antimicrobial activity
VILGNGISNIAQTLGQLPNIAWVWIYMVLIAALLEESNVC

SEQ ID NO: 227 - protein, 30 aa, Artificial
  Peptide with targeting and/or antimicrobial activity
KQVQNTTLIICGTVLLGILFKSYLKSQKSV

SEQ ID NO: 228 - protein, 36 aa, Artificial
  Peptide with targeting and/or antimicrobial activity
SENIARFAAAFENEQVVSYARWFRRSWRGSGSSSRF

SEQ ID NO: 229 - protein, 9 aa, Artificial
  Peptide with targeting and/or antimicrobial activity
IGGALNSCG

SEQ ID NO: 230 - protein, 52 aa, Artificial
  Peptide with targeting and/or antimicrobial activity
VFSVLKHTTWPTRKQSWHDFISILEYSAFFALVIFIFDKLLTLGLAELLKRF

SEQ ID NO: 231 - protein, 38 aa, Artificial
  Peptide with targeting and/or antimicrobial activity
LVQGDTILIENHVGTPVKDDGKDCLIIREADVLAVVND

SEQ ID NO: 232 - protein, 30 aa, Artificial
  Peptide with targeting and/or antimicrobial activity
MKKNLKRFYALVLGFIIGCLFVSILIFIGY

SEQ ID NO: 233 - protein, 41 aa, Artificial
  Peptide with targeting and/or antimicrobial activity
KTKESLTQQEKKFLKDYDRKSLHHFRDILTYCFILDKLTNK

SEQ ID NO: 234 - protein, 20 aa, Artificial
  Peptide with targeting and/or antimicrobial activity
KGKSLMPLLKQINQWGKLYL

SEQ ID NO: 235 - protein, 48 aa, Artificial
  Peptide with targeting and/or antimicrobial activity
IILAKAADLAEIERIISEDPFKINEIANYDIIEFCPTKSSKAFEKVLK

SEQ ID NO: 236 - protein, 29 aa, Artificial
  Peptide with targeting and/or antimicrobial activity
TINIDDKVLDYLKKINSKAITIDLIGCAS

SEQ ID NO: 237 - protein, 20 aa, Artificial
  Peptide with targeting and/or antimicrobial activity
EKLKKILLKLAVCGKAWYTL

SEQ ID NO: 238 - protein, 32 aa, Artificial
  Peptide with targeting and/or antimicrobial activity
NILYFIHDENQWEPQKAEIFRGSIKHCAWLSS

SEQ ID NO: 239 - protein, 29 aa, Artificial
  Peptide with targeting and/or antimicrobial activity
SFEKNKIENNLKIAQAYIYIKPKPRICQA

SEQ ID NO: 240 - protein, 12 aa, Artificial
  Peptide with targeting and/or antimicrobial activity
LSLPLIVLTKSI

SEQ ID NO: 241 - protein, 23 aa, Artificial
  Peptide with targeting and/or antimicrobial activity
FIAVSFTGNPATFKLVIGCKADN

SEQ ID NO: 242 - protein, 22 aa, Artificial
  Peptide with targeting and/or antimicrobial activity
LEGKFYMAEDFDKTPECFKDYV

SEQ ID NO: 243 - protein, 30 aa, Artificial
  Peptide with targeting and/or antimicrobial activity
GMFENLLMINFQIMNDLKIEIVVKDRICAV

SEQ ID NO: 244 - protein, 12 aa, Artificial
  Peptide with targeting and/or antimicrobial activity
RAGTWLVVDEIR

SEQ ID NO: 245 - protein, 26 aa, Artificial
  Peptide with targeting and/or antimicrobial activity
RIKEERKNRSYKFFIWRLFDEKTGFI

SEQ ID NO: 246 - protein, 26 aa, Artificial
  Peptide with targeting and/or antimicrobial activity
PITPKKEKCGLGTYAPKNPVFSKSRV

SEQ ID NO: 247 - protein, 16 aa, Artificial
  Peptide with targeting and/or antimicrobial activity
PLYVAAVEKINTAKKH

SEQ ID NO: 248 - protein, 13 aa, Artificial
  Peptide with targeting and/or antimicrobial activity
VHEFDIQKILQNR

SEQ ID NO: 249 - protein, 29 aa, Artificial
  Peptide with targeting and/or antimicrobial activity
FLIQKFLLIKTFPPYRKKYVVIVSQTGTA

SEQ ID NO: 250 - protein, 31 aa, Artificial
  Peptide with targeting and/or antimicrobial activity
QLAPIDKQLKAVKKIAFYESESTAAKAVTVA

SEQ ID NO: 251 - protein, 31 aa, Artificial
  Peptide with targeting and/or antimicrobial activity
YNEPNYKWLESYKIYKQRCEDRTGMYYTEET

SEQ ID NO: 252 - protein, 26 aa, Artificial
  Peptide with targeting and/or antimicrobial activity
ETTTEINAIKLHRIKQRSPQGTRRVN

SEQ ID NO: 253 - protein, 30 aa, Artificial
  Peptide with targeting and/or antimicrobial activity
QVLKNFSISRRYKINNPFFKILLFIQLRTL

SEQ ID NO: 254 - protein, 24 aa, Artificial
  Peptide with targeting and/or antimicrobial activity
ILTLLILGSIGFFILKIKLKLGRF

SEQ ID NO: 255 - protein, 18 aa, Artificial
  Peptide with targeting and/or antimicrobial activity
IYYMRFVNKPLEKTFFKI

SEQ ID NO: 256 - protein, 26 aa, Artificial
  Peptide with targeting and/or antimicrobial activity
SINSSAGIQPHCLSSSFVLRTKHCFY

SEQ ID NO: 257 - protein, 10 aa, Artificial
  Peptide with targeting and/or antimicrobial activity
FVLRTKHCFY

SEQ ID NO: 258 - protein, 29 aa, Artificial
  Peptide with targeting and/or antimicrobial activity
TNNKNKVIIKAIKFKNKDFINLDLFIYRR

SEQ ID NO: 259 - protein, 28 aa, Artificial
  Peptide with targeting and/or antimicrobial activity
KYEKLTKENLFIRNSGNMCVFIYFLFFG

SEQ ID NO: 260 - protein, 9 aa, Artificial
  Peptide with targeting and/or antimicrobial activity
ISLVFPAYT

SEQ ID NO: 261 - protein, 32 aa, Artificial
  Peptide with targeting and/or antimicrobial activity
LCTKLEDKQRGRIPAELFIISPIKILERNDAL

SEQ ID NO: 262 - protein, 10 aa, Artificial
  Peptide with targeting and/or antimicrobial activity
FQYYFSLKRV

SEQ ID NO: 263 - protein, 31 aa, Artificial
  Peptide with targeting and/or antimicrobial activity
FFPYYLADFYKQLKFLNEYQTKNKDKVVEFK

SEQ ID NO: 264 - protein, 29 aa, Artificial
  Peptide with targeting and/or antimicrobial activity
LGFFNNKADLVKADTERDNRMSSLKIKDL

SEQ ID NO: 265 - protein, 14 aa, Artificial
  Peptide with targeting and/or antimicrobial activity
KGYPLPFQYRLNNH

SEQ ID NO: 266 - protein, 20 aa, Artificial
  Peptide with targeting and/or antimicrobial activity
RWVGGEPSADIYLSAKDTKT

SEQ ID NO: 267 - protein, 15 aa, Artificial
  Peptide with targeting and/or antimicrobial activity
EPSADIYLSAKDTKT

SEQ ID NO: 268 - protein, 18 aa, Artificial
  Peptide with targeting and/or antimicrobial activity
IINQLNLILLRLMEILIL

SEQ ID NO: 269 - protein, 31 aa, Artificial
  Peptide with targeting and/or antimicrobial activity
DMKIIKLYIKILSFLFIKYCNKKLNSVKLKA

SEQ ID NO: 270 - protein, 18 aa, Artificial
  Peptide with targeting and/or antimicrobial activity
IINQLNLILLRLMEILIL

SEQ ID NO: 271 - protein, 32 aa, Artificial
  Peptide with targeting and/or antimicrobial activity
HVEDCFLLSNARTTAIHGRANPARGEPRTRSE

SEQ ID NO: 272 - protein, 17 aa, Artificial
  Peptide with targeting and/or antimicrobial activity
YDKIADGVFKIGKRGVL

SEQ ID NO: 273 - protein, 9 aa, Artificial
  Peptide with targeting and/or antimicrobial activity
KYKLKKIIL

SEQ ID NO: 274 - protein, 20 aa, Artificial
  Peptide with targeting and/or antimicrobial activity
EYSQQSFKAKPCSERGVLSP

SEQ ID NO: 275 - protein, 32 aa, Artificial
  Peptide with targeting and/or antimicrobial activity
RSLRLNNALTKLPKLWYNRIKEAFYAYNDYDK

SEQ ID NO: 276 - protein, 29 aa, Artificial
  Peptide with targeting and/or antimicrobial activity
ILNKKPKLPLWKLGKNYFRRFYVLPTFLA

SEQ ID NO: 277 - protein, 23 aa, Artificial
  Peptide with targeting and/or antimicrobial activity
SMLTSFLRSKNTRSLKMYKDVHF

SEQ ID NO: 278 - protein, 29 aa, Artificial
  Peptide with targeting and/or antimicrobial activity
PLIISKAQIKMSGDILGSCFKLFYLRPFF

SEQ ID NO: 279 - protein, 13 aa, Artificial
  Peptide with targeting and/or antimicrobial activity
SKLPRVLDASLKL

SEQ ID NO: 280 - protein, 15 aa, Artificial
  Peptide with targeting and/or antimicrobial activity
IIIILPKIYLVCKTV

SEQ ID NO: 281 - protein, 14 aa, Artificial
  Peptide with targeting and/or antimicrobial activity
LDYENMDCKKRIRI

SEQ ID NO: 282 - protein, 24 aa, Artificial
  Peptide with targeting and/or antimicrobial activity
STAGEASRRTASEASRRTAAKLRG

SEQ ID NO: 283 - protein, 26 aa, Artificial
  Peptide with targeting and/or antimicrobial activity
ARNALNMRDVPVDAAIIGIIDGMDEE

SEQ ID NO: 284 - protein, 25 aa, Artificial
  Peptide with targeting and/or antimicrobial activity
KILNEAEGKLLKVIEKNGEIDIEEI

SEQ ID NO: 285 - protein, 24 aa, Artificial
  Peptide with targeting and/or antimicrobial activity
NGDKKAKEELDKWDEVIKELNIQF

SEQ ID NO: 286 - protein, 34 aa, Artificial
  Peptide with targeting and/or antimicrobial activity
GLVIIPNLIALIILFSQVRQQTKDYFSNPKLSSR

SEQ ID NO: 287 - protein, 34 aa, Artificial
  Peptide with targeting and/or antimicrobial activity
EPLPLTKYDKKDTEMKKVFKEILAGKVGYEKEEE

SEQ ID NO: 288 - protein, 23 aa, Artificial
  Peptide with targeting and/or antimicrobial activity
TKLKKNNKLLSAKKENTLHTKDK

SEQ ID NO: 289 - protein, 9 aa, Artificial
  Peptide with targeting and/or antimicrobial activity
AIFDAMHNL

SEQ ID NO: 290 - protein, 9 aa, Artificial
  Peptide with targeting and/or antimicrobial activity
  mod_res (1)..(1): D lysine
  mod_res (2)..(2): D ornithine
  mod_res (4)..(4): D threonine
  mod_res (8)..(8): D serine
  mod_res (9)..(9): D ornithine
XXGXTQGXX

SEQ ID NO: 291 - protein, 8 aa, Artificial
  Peptide with targeting and/or antimicrobial activity
  mod_res (2)..(2): D ornithine
  mod_res (7)..(7): D ornithine
DXKTAAXK

SEQ ID NO: 292 - protein, 9 aa, Artificial
  Peptide with targeting and/or antimicrobial activity
  mod_res (3)..(3): D Asp
  mod_res (5)..(5): D Thr
  mod_res (6)..(6): D Ala
  mod_res (8)..(8): D Lys
  mod_res (9)..(9): D ornithine
DKXSXXTXX

SEQ ID NO: 293 - protein, 10 aa, Artificial
  Peptide with targeting and/or antimicrobial activity
  mod_res (1)..(1): D Ser
  mod_res (4)..(4): D Ser
  mod_res (6)..(6): D Ser
  mod_res (7)..(7): D ornithine
  mod_res (9)..(9): D Ser
  mod_res (10)..(10): D Ser
XKSXTXXTXX

SEQ ID NO: 294 - protein, 8 aa, Artificial
  Peptide with targeting and/or antimicrobial activity
  mod_res (1)..(1): D Ser
  mod_res (3)..(3): D Ser
  mod_res (4)..(4): Ornithine
  mod_res (6)..(6): Ornithine
XRXXKXTT

SEQ ID NO: 295 - protein, 7 aa, Artificial
  Peptide with targeting and/or antimicrobial activity
  mod_res (1)..(1): D Ser
  mod_res (2)..(2): D aminobutyric acid
  mod_res (3)..(3): Ornithine
  mod_res (4)..(4): D Gln
  mod_res (6)..(6): D ornithine
XXXXQXG

SEQ ID NO: 296 - protein, 7 aa, Artificial
  Peptide with targeting and/or antimicrobial activity
  mod_res (1)..(1): D Ser
  mod_res (2)..(2): D ornithine
  mod_res (3)..(3): Ornithine
  mod_res (5)..(5): D Thr
  mod_res (7)..(7): Ornithine
XXXGXSX

SEQ ID NO: 297 - protein, 6 aa, Artificial
  Peptide with targeting and/or antimicrobial activity
  mod_res (1)..(1): D Ala
  mod_res (4)..(4): D Ser
  mod_res (5)..(6): Ornithine
XKTXXX

SEQ ID NO: 298 - protein, 9 aa, Artificial
  Peptide with targeting and/or antimicrobial activity
  mod_res (1)..(1): D Ser
  mod_res (2)..(2): D ornithine
  mod_res (4)..(4): D Thr
  mod_res (8)..(8): D Ser
  mod_res (9)..(9): D ornithine
XXGXTQGXX

SEQ ID NO: 299 - protein, 6 aa, Artificial
  Peptide with targeting and/or antimicrobial activity
  mod_res (2)..(2): D Asp
  mod_res (4)..(4): D Thr
  mod_res (6)..(6): D ornithine
KXAXAX

SEQ ID NO: 300 - protein, 8 aa, Artificial
  Peptide with targeting and/or antimicrobial activity
  mod_res (2)..(2): D ornithine
  mod_res (5)..(5): D Ala
  misc_feature (6)..(6): Xaa can be any naturally occurring amino acid
  mod_res (7)..(7): D ornithine
NXKTXXXK

SEQ ID NO: 301 - protein, 12 aa, Artificial
  Peptide with targeting and/or antimicrobial activity
  mod_res (1)..(1): D Ala
  mod_res (6)..(6): D Gln
  mod_res (7)..(7): D Ser
  mod_res (9)..(10): D Ala
  mod_res (12)..(12): Ornithine
XKGGDXXAXXAX

SEQ ID NO: 302 - protein, 11 aa, Artificial
  Peptide with targeting and/or antimicrobial activity
  mod_res (1)..(1): D Ser
  mod_res (4)..(4): Ornithine
  mod_res (5)..(5): D Ser
  mod_res (9)..(9): D ornithine
XKGXXSGKXES

SEQ ID NO: 303 - protein, 10 aa, Artificial
  Peptide with targeting and/or antimicrobial activity
  mod_res (1)..(1): D Ser
  mod_res (2)..(2): D aminobutyric acid
  mod_res (8)..(8): D Ala
  mod_res (10)..(10): Ornithine
XXGSDAGXGX

SEQ ID NO: 304 - protein, 7 aa, Artificial
  Peptide with targeting and/or antimicrobial activity
  mod_res (4)..(4): Ornithine
  mod_res (6)..(6): D ornithine
SKGXKXS

SEQ ID NO: 305 - protein, 10 aa, Artificial
  Peptide with targeting and/or antimicrobial activity
  mod_res (1)..(1): D Ala
  mod_res (2)..(2): D Lys
  mod_res (6)..(6): D Gln
  mod_res (7)..(7): D aminobutyric acid
  mod_res (9)..(9): D Ala
  mod_res (10)..(10): Ornithine
XXGGDXXSXX

SEQ ID NO: 306 - protein, 11 aa, Artificial
  Peptide with targeting and/or antimicrobial activity
  mod_res (1)..(1): D Ala
  mod_res (2)..(2): D Lys
  mod_res (5)..(5): D Asp
  mod_res (6)..(6): D Gln
  mod_res (7)..(7): D Ser
  mod_res (10)..(10): D Thr
  mod_res (11)..(11): Ornithine
XXGGXXXAGXX

SEQ ID NO: 307 - protein, 6 aa, Artificial
  Peptide with targeting and/or antimicrobial activity
  mod_res (1)..(1): D Ser
  mod_res (4)..(4): D Thr
  mod_res (6)..(6): Ornithine
XKHXSX

SEQ ID NO: 308 - protein, 8 aa, Artificial
  Peptide with targeting and/or antimicrobial activity
  mod_res (1)..(1): D Ser
  mod_res (2)..(2): D Ala
  mod_res (3)..(3): D Orn
  mod_res (5)..(5): D Ser
  mod_res (6)..(6): D Asp
  mod_res (7)..(7): D Ser
  mod_res (8)..(8): D Thr
XXXGXXXX

SEQ ID NO: 309 - protein, 10 aa, Artificial
  Peptide with targeting and/or antimicrobial activity
  mod_res (1)..(1): D Ala
  mod_res (2)..(2): D Lys
  mod_res (6)..(6): D Gln
  mod_res (7)..(7): D aminobutyric acid
  mod_res (10)..(10): Orn
XXGGDXXGSX

SEQ ID NO: 310 - protein, 10 aa, Artificial
  Peptide with targeting and/or antimicrobial activity
  mod_res (1)..(1): D Ser
  mod_res (4)..(4): Orn
  mod_res (6)..(6): D Ser
  mod_res (9)..(9): D Orn
XKGXSXGKXS

SEQ ID NO: 311 - protein, 7 aa, Artificial
  Peptide with targeting and/or antimicrobial activity
  mod_res (1)..(1): D Ser
  mod_res (2)..(2): D Orn
  mod_res (5)..(5): D Thr
  mod_res (7)..(7): Orn
XXAGXAX

SEQ ID NO: 312 - protein, 7 aa, Artificial
  Peptide with targeting and/or antimicrobial activity
  mod_res (1)..(1): D Lys
  mod_res (2)..(2): D Orn
  mod_res (5)..(5): D Thr
  mod_res (7)..(7): Orn
XXAGXSX

SEQ ID NO: 313 - protein, 9 aa, Artificial
  Peptide with targeting and/or antimicrobial activity
  mod_res (1)..(2): D Ser
  mod_res (3)..(3): Orn
  mod_res (4)..(6): D Ser
  mod_res (7)..(7): Orn
XXXXXXXKK

SEQ ID NO: 314 - protein, 9 aa, Artificial
  Peptide with targeting and/or antimicrobial activity
  mod_res (4)..(4): D Ser
  mod_res (6)..(6): D Ala
  mod_res (7)..(7): D Glu
  mod_res (8)..(8): D Ser
  mod_res (9)..(9): Orn
DKDXTXXXX

SEQ ID NO: 315 - protein, 10 aa, Artificial
  Peptide with targeting and/or antimicrobial activity
  mod_res (3)..(3): D Ser
  mod_res (4)..(4): Orn
  mod_res (6)..(6): D Gln
  mod_res (7)..(7): D aminobutyric acid
  mod_res (9)..(9): D Thr
  mod_res (10)..(10): Orn
STXXDXXSXX

SEQ ID NO: 316 - protein, 9 aa, Artificial
  Peptide with targeting and/or antimicrobial activity
  mod_res (2)..(2): D Orn
  mod_res (3)..(3): D aminobutyric acid
  mod_res (6)..(6): D Ser
DXXTGXSDT

SEQ ID NO: 317 - protein, 7 aa, Artificial
  Peptide with targeting and/or antimicrobial activity
  mod_res (2)..(2): Orn
  mod_res (3)..(3): D Asp
  mod_res (4)..(4): D aminobutyric acid
  mod_res (7)..(7): Orn
DXXXGSX

SEQ ID NO: 318 - protein, 9 aa, Artificial
  Peptide with targeting and/or antimicrobial activity
  mod_res (2)..(2): D Orn
  mod_res (3)..(3): D aminobutyric acid
  mod_res (6)..(7): D Ser
DXXTGXXTD

SEQ ID NO: 319 - protein, 8 aa, Artificial
  Peptide with targeting and/or antimicrobial activity
  mod_res (1)..(1): D Ser
  mod_res (2)..(2): D Ala
  mod_res (3)..(3): D Orn
  mod_res (5)..(5): D Ala
  mod_res (6)..(6): D Asp
  mod_res (7)..(7): DSer
  mod_res (8)..(8): D Thr
XXXGXXXX

SEQ ID NO: 320 - protein, 6 aa, Artificial
  Peptide with targeting and/or antimicrobial activity
  mod_res (4)..(4): D Orn
  mod_res (6)..(6): Orn
DADXSX

SEQ ID NO: 321 - protein, 10 aa, Artificial
  Peptide with targeting and/or antimicrobial activity
  mod_res (1)..(1): D Ser
  mod_res (4)..(4): D Ser
  mod_res (6)..(6): D Ser
  mod_res (7)..(7): Orn
  mod_res (9)..(9): D Ser
  mod_res (10)..(10): Orn
XKSXTXXTXX

SEQ ID NO: 322 - protein, 8 aa, Artificial
  Peptide with targeting and/or antimicrobial activity
  mod_res (1)..(1): D Ser
  mod_res (2)..(2): D Asp
  mod_res (3)..(3): D Thr
  mod_res (4)..(4): D Ser
  mod_res (5)..(5): D Orn
  mod_res (8)..(8): D Ser
XXXXXAGX

SEQ ID NO: 323 - protein, 8 aa, Artificial
  Peptide with targeting and/or antimicrobial activity
  mod_res (1)..(1): D Ser
  mod_res (2)..(2): D Ala
  mod_res (4)..(4): D Ser
  mod_res (5)..(5): D Ala
  mod_res (6)..(6): D Asp
  mod_res (7)..(7): D Thr
  mod_res (8)..(8): D Orn
XXGXXXXX

SEQ ID NO: 324 - protein, 6 aa, Artificial
  Peptide with targeting and/or antimicrobial activity
  mod_res (1)..(1): Hse
  mod_res (2)..(2): D Hse
  mod_res (3)..(3): Dab
  mod_res (4)..(4): D Orn
  mod_res (5)..(5): D Ser
  mod_res (6)..(6): Orn
XXXXXX

SEQ ID NO: 325 - protein, 23 aa, Artificial
  Peptide with targeting and/or antimicrobial activity
SKRGRKRKDRRKKKANHGKRPNS

SEQ ID NO: 326 - protein, 30 aa, Artificial
  Peptide with targeting and/or antimicrobial activity
MNNWIIVAQLSVTVINEIIDIMKEKQKGGK

SEQ ID NO: 327 - protein, 5 aa, Artificial
  Peptide with targeting and/or antimicrobial activity
NDDAQ

SEQ ID NO: 328 - protein, 30 aa, Artificial
  Peptide with targeting and/or antimicrobial activity
MNNWIKVAQISVTVINEVIDIMKEKQNGGK

SEQ ID NO: 329 - protein, 23 aa, Artificial
  Peptide with targeting and/or antimicrobial activity
ARLSKAIIIAVIVVYHLDVRGLF

SEQ ID NO: 330 - protein, 30 aa, Artificial
  Peptide with targeting and/or antimicrobial activity
MESIFKIKLMNGICRSENMNMKKKNKGEKI

SEQ ID NO: 331 - protein, 21 aa, Artificial
  Peptide with targeting and/or antimicrobial activity
MGIIAGIIKFIKGLIEKFTGK

SEQ ID NO: 332 - protein, 21 aa, Artificial
  Peptide with targeting and/or antimicrobial activity
MGIIAGIIKVIKSLIEQFTGK

SEQ ID NO: 333 - protein, 26 aa, Artificial
  Peptide with targeting and/or antimicrobial activity
MIEIGSIAYLNGGSKKYNHILNQENR

SEQ ID NO: 334 - protein, 13 aa, Artificial
  Peptide with targeting and/or antimicrobial activity
SKKYNHILNQENR

SEQ ID NO: 335 - protein, 26 aa, Artificial
  Peptide with targeting and/or antimicrobial activity
MDIDVNKLLQAFVYFKSFEKLRHNNS

SEQ ID NO: 336 - protein, 30 aa, Artificial
  Peptide with targeting and/or antimicrobial activity
MFCYYKQHKGDNFSIEEVKNIIADNEMKVN

SEQ ID NO: 337 - protein, 24 aa, Artificial
  Peptide with targeting and/or antimicrobial activity
WRGPNTEAGGKSANNIVQVGGAPT

SEQ ID NO: 338 - protein, 23 aa, Artificial
  Peptide with targeting and/or antimicrobial activity
LIQKGLNQTFIVVIRLNNFIKKS

SEQ ID NO: 339 - protein, 8 aa, Artificial
  Peptide with targeting and/or antimicrobial activity
HPTDNKHN

SEQ ID NO: 340 - protein, 14 aa, Artificial
  Peptide with targeting and/or antimicrobial activity
SIDKRNLYNLKYYE

SEQ ID NO: 341 - protein, 13 aa, Artificial
  Peptide with targeting and/or antimicrobial activity
RKQYDDLSFNFLY

SEQ ID NO: 342 - protein, 5 aa, Artificial
  Peptide with targeting and/or antimicrobial activity
ESIIE

SEQ ID NO: 343 - protein, 9 aa, Artificial
  Peptide with targeting and/or antimicrobial activity
YYKTYFKEV

SEQ ID NO: 344 - protein, 30 aa, Artificial
  Peptide with targeting and/or antimicrobial activity
MKIILLLFLIFGFIVVVTLKSEHQLTLFSI

SEQ ID NO: 345 - protein, 14 aa, Artificial
  Peptide with targeting and/or antimicrobial activity
FSLNFSKQKYVTVN

SEQ ID NO: 346 - protein, 24 aa, Artificial
  Peptide with targeting and/or antimicrobial activity
MINELKNKNSGIMNNYVVTKESKL

SEQ ID NO: 347 - protein, 30 aa, Artificial
  Peptide with targeting and/or antimicrobial activity
MTKNTIISLENEKTQINDSENESSDLRKAK

SEQ ID NO: 348 - protein, 6 aa, Artificial
  Peptide with targeting and/or antimicrobial activity
DLRKAK

SEQ ID NO: 349 - protein, 17 aa, Artificial
  Peptide with targeting and/or antimicrobial activity
LLIIFRLWLELKWKNKK

SEQ ID NO: 350 - protein, 6 aa, Artificial
  Peptide with targeting and/or antimicrobial activity
SIHFIN

SEQ ID NO: 351 - protein, 25 aa, Artificial
  Peptide with targeting and/or antimicrobial activity
HNARKYLEFISQKIDGDKLTKEDSL

SEQ ID NO: 352 - protein, 25 aa, Artificial
  Peptide with targeting and/or antimicrobial activity
ALDCSEQSVILWYETILDKIVGVIK

SEQ ID NO: 353 - protein, 5 aa, Artificial
  Peptide with targeting and/or antimicrobial activity
NSTNE

SEQ ID NO: 354 - protein, 16 aa, Artificial
  Peptide with targeting and/or antimicrobial activity
MTCHQAPTTTHQSNMA

SEQ ID NO: 355 - protein, 30 aa, Artificial
  Peptide with targeting and/or antimicrobial activity
MPHHSTTSSRIVVPAHQSNMASTPNLSITP

SEQ ID NO: 356 - protein, 30 aa, Artificial
  Peptide with targeting and/or antimicrobial activity
MFIFKTTSKSHFHNNVKSLECIKIPINKNR

SEQ ID NO: 357 - protein, 17 aa, Artificial
  Peptide with targeting and/or antimicrobial activity
EPKKKHFPKMESASSEP

SEQ ID NO: 358 - protein, 6 aa, Artificial
  Peptide with targeting and/or antimicrobial activity
SFYESY

SEQ ID NO: 359 - protein, 21 aa, Artificial
  Peptide with targeting and/or antimicrobial activity
ILNRLSRIVSNEVTSLIYSLK

SEQ ID NO: 360 - protein, 30 aa, Artificial
  Peptide with targeting and/or antimicrobial activity
MTKKRRYDTTEFGLAHSMTAKITLHQALYK

SEQ ID NO: 361 - protein, 19 aa, Artificial
  Peptide with targeting and/or antimicrobial activity
MAYKDEGKETKFAVKGYKD

SEQ ID NO: 362 - protein, 9 aa, Artificial
  Peptide with targeting and/or antimicrobial activity
MLEEKNKSL

SEQ ID NO: 363 - protein, 30 aa, Artificial
  Peptide with targeting and/or antimicrobial activity
MIHLTKQNTMEALHFIKQFYDMFFILNFNV

SEQ ID NO: 364 - protein, 10 aa, Artificial
  Peptide with targeting and/or antimicrobial activity
ELLVILPGFI

SEQ ID NO: 365 - protein, 17 aa, Artificial
  Peptide with targeting and/or antimicrobial activity
LLLSYFRYTGALLQSLF

SEQ ID NO: 366 - protein, 22 aa, Artificial
  Peptide with targeting and/or antimicrobial activity
MIKNETAYQMNELLVIRSAYAK

SEQ ID NO: 367 - protein, 10 aa, Artificial
  Peptide with targeting and/or antimicrobial activity
KLKKYIHKPD

SEQ ID NO: 368 - protein, 10 aa, Artificial
  Peptide with targeting and/or antimicrobial activity
LDINDYRSTY

SEQ ID NO: 369 - protein, 13 aa, Artificial
  Peptide with targeting and/or antimicrobial activity
LDFYLTKHLTLML

SEQ ID NO: 370 - protein, 17 aa, Artificial
  Peptide with targeting and/or antimicrobial activity
NQEPSLQQDKEQKDNKG

SEQ ID NO: 371 - protein, 20 aa, Artificial
  Peptide with targeting and/or antimicrobial activity
LYFAFKKYQERVNQAPNIEY

SEQ ID NO: 372 - protein, 12 aa, Artificial
  Peptide with targeting and/or antimicrobial activity
AYYLKRREEKGK

SEQ ID NO: 373 - protein, 12 aa, Artificial
  Peptide with targeting and/or antimicrobial activity
SYYLKRREEKGK

SEQ ID NO: 374 - protein, 25 aa, Artificial
  Peptide with targeting and/or antimicrobial activity
RFFNFEIKKSTKVDYVFAHVDLSDV

SEQ ID NO: 375 - protein, 15 aa, Artificial
  Peptide with targeting and/or antimicrobial activity
QELINEAVNLLVKSK

SEQ ID NO: 376 - protein, 38 aa, Artificial
  Peptide with targeting and/or antimicrobial activity
KLFGQWGPELGSIYILPALIGSIILIAIVTLILRAMRK

SEQ ID NO: 377 - protein, 21 aa, Artificial
  Peptide with targeting and/or antimicrobial activity
VSISRFIGGGHVFNGNNKRNL

SEQ ID NO: 378 - protein, 12 aa, Artificial
  Peptide with targeting and/or antimicrobial activity
GHVFNGNNKRNL

SEQ ID NO: 379 - protein, 40 aa, Artificial
  Peptide with targeting and/or antimicrobial activity
AEQLFGKQKQRGVDLFLNRLTIILSILFFVLMICISYLGM

SEQ ID NO: 380 - protein, 22 aa, Artificial
  Peptide with targeting and/or antimicrobial activity
TMIVISIPRFEEYMKARHKKWM

SEQ ID NO: 381 - protein, 9 aa, Artificial
  Peptide with targeting and/or antimicrobial activity
FADQSQDNA

SEQ ID NO: 382 - protein, 5 aa, Artificial
  Peptide with targeting and/or antimicrobial activity
HSSHL

SEQ ID NO: 383 - protein, 24 aa, Artificial
  Peptide with targeting and/or antimicrobial activity
GYNSYKAVQDVKTHSEEQRVTAKK

SEQ ID NO: 384 - protein, 32 aa, Artificial
  Peptide with targeting and/or antimicrobial activity
MKKKRINNDILGRMIYSSSIDKRNLYNLKYYE

SEQ ID NO: 385 - protein, 26 aa, Artificial
  Peptide with targeting and/or antimicrobial activity
IAAIIVLVLFQKGLLQIFNWILIQLQ

SEQ ID NO: 386 - protein, 6 aa, Artificial
  Peptide with targeting and/or antimicrobial activity
DYYGKE

SEQ ID NO: 387 - protein, 35 aa, Artificial
  Peptide with targeting and/or antimicrobial activity
LEKNTRDNYFIHAIDRIYINTSKGLFPESELVAWG

SEQ ID NO: 388 - protein, 37 aa, Artificial
  Peptide with targeting and/or antimicrobial activity
IKGTVKAVDETTVVITVNGHGTELTFEKPAIKQVDPS

SEQ ID NO: 389 - protein, 30 aa, Artificial
  Peptide with targeting and/or antimicrobial activity
DLIVKVHICFVVKTASGYCYLNKREAQAAI

SEQ ID NO: 390 - protein, 37 aa, Artificial
  Peptide with targeting and/or antimicrobial activity
SHLINNFGLSVINPSTPICLNFSPVFNLLTVYGITCN

SEQ ID NO: 391 - protein, 21 aa, Artificial
  Peptide with targeting and/or antimicrobial activity
FDPVPLKKDKSASKHSHKHNH

SEQ ID NO: 392 - protein, 18 aa, Artificial
  Peptide with targeting and/or antimicrobial activity
SMVKSEIVDLLNGEDNDD

SEQ ID NO: 393 - protein, 30 aa, Artificial
  Peptide with targeting and/or antimicrobial activity
HCVIGNVVDIANLLKRRAVYRDIADVIKMR

SEQ ID NO: 394 - protein, 36 aa, Artificial
  Peptide with targeting and/or antimicrobial activity
CPSVTMDACALLQKFDFCNNISHFRHFFAIKQPIER

SEQ ID NO: 395 - protein, 12 aa, Artificial
  Peptide with targeting and/or antimicrobial activity
RDIHPIYFMTKD

SEQ ID NO: 396 - protein, 28 aa, Artificial
  Peptide with targeting and/or antimicrobial activity
FVNSLIMKDLSDNDMRFKYEYYNREKDT

SEQ ID NO: 397 - protein, 27 aa, Artificial
  Peptide with targeting and/or antimicrobial activity
LYQYELLSKEEYLKCTLIINQRRNEQK

SEQ ID NO: 398 - protein, 22 aa, Artificial
  Peptide with targeting and/or antimicrobial activity
QPTQGEQGTRPRRPTPMRGLLI

SEQ ID NO: 399 - protein, 13 aa, Artificial
  Peptide with targeting and/or antimicrobial activity
EIIAYLEGRFANA

SEQ ID NO: 400 - protein, 21 aa, Artificial
  Peptide with targeting and/or antimicrobial activity
DPVPERQEQACACHRTAKPGK

SEQ ID NO: 401 - protein, 10 aa, Artificial
  Peptide with targeting and/or antimicrobial activity
ERTAVNDLWI

SEQ ID NO: 402 - protein, 28 aa, Artificial
  Peptide with targeting and/or antimicrobial activity
TTRPQVAEDRQLDDALKETFPASDPISP

SEQ ID NO: 403 - protein, 38 aa, Artificial
  Peptide with targeting and/or antimicrobial activity
MADGQIAAIAKLHGVPVATRNIRHFQSFGVELINPWSG

SEQ ID NO: 404 - protein, 22 aa, Artificial
  Peptide with targeting and/or antimicrobial activity
YVVGALVILAVAGLIYSMLRKA

SEQ ID NO: 405 - protein, 34 aa, Artificial
  Peptide with targeting and/or antimicrobial activity
FSPEAFGIGAAGVLGSFVTGLLIGWVASLLRKAK

SEQ ID NO: 406 - protein, 30 aa, Artificial
  Peptide with targeting and/or antimicrobial activity
MLRYLSLFAVGLATGYAWGWIDGLAASLAV

SEQ ID NO: 407 - protein, 24 aa, Artificial
  Peptide with targeting and/or antimicrobial activity
GIKVVAARFEEIQFSENFDSIILA

SEQ ID NO: 408 - protein, 17 aa, Artificial
  Peptide with targeting and/or antimicrobial activity
MKLLARDPWVCAWNDIW

SEQ ID NO: 409 - protein, 17 aa, Artificial
  Peptide with targeting and/or antimicrobial activity
LQRSDEESMPRRHEKYS

SEQ ID NO: 410 - protein, 12 aa, Artificial
  Peptide with targeting and/or antimicrobial activity
RRAAARTKGNRR

SEQ ID NO: 411 - protein, 13 aa, Artificial
  Peptide with targeting and/or antimicrobial activity
RPGDGAAEQGRSR

SEQ ID NO: 412 - protein, 13 aa, Artificial
  Peptide with targeting and/or antimicrobial activity
GDPTAGQKPVECP

SEQ ID NO: 413 - protein, 12 aa, Artificial
  Peptide with targeting and/or antimicrobial activity
GKAMKRQDCSAL

SEQ ID NO: 414 - protein, 24 aa, Artificial
  Peptide with targeting and/or antimicrobial activity
PPARPARIPQTPTLHGASLFRQRS

SEQ ID NO: 415 - protein, 15 aa, Artificial
  Peptide with targeting and/or antimicrobial activity
LRGRVGRITACGYPP

SEQ ID NO: 416 - protein, 27 aa, Artificial
  Peptide with targeting and/or antimicrobial activity
VLGKGHDLLDVGKTALKSRVFAWLGGS

SEQ ID NO: 417 - protein, 9 aa, Artificial
  Peptide with targeting and/or antimicrobial activity
AVHHSLLFR

SEQ ID NO: 418 - protein, 19 aa, Artificial
  Peptide with targeting and/or antimicrobial activity
ALSKPAIQARTLCRRQDPP

SEQ ID NO: 419 - protein, 27 aa, Artificial
  Peptide with targeting and/or antimicrobial activity
FHRRVIRASEWALTTRSFSTPLRSAAR

SEQ ID NO: 420 - protein, 8 aa, Artificial
  Peptide with targeting and/or antimicrobial activity
VVRRFQGM

SEQ ID NO: 421 - protein, 10 aa, Artificial
  Peptide with targeting and/or antimicrobial activity
GIDRGCQAAR

SEQ ID NO: 422 - protein, 22 aa, Artificial
  Peptide with targeting and/or antimicrobial activity
LSPRPIIVSRRSRADNNNDWSR

SEQ ID NO: 423 - protein, 16 aa, Artificial
  Peptide with targeting and/or antimicrobial activity
RSGQPVGRPSRRAWLR

SEQ ID NO: 424 - protein, 24 aa, Artificial
  Peptide with targeting and/or antimicrobial activity
GIVLTGRAGLVSGACSMALGVGLG

SEQ ID NO: 425 - protein, 17 aa, Artificial
  Peptide with targeting and/or antimicrobial activity
GCGKRRIITKSASRDTR

SEQ ID NO: 426 - protein, 17 aa, Artificial
  Peptide with targeting and/or antimicrobial activity
RRPRRRRSGHGQSASAA

SEQ ID NO: 427 - protein, 25 aa, Artificial
  Peptide with targeting and/or antimicrobial activity
RRGCTERLRRMARRNAWDLYAEHFY

SEQ ID NO: 428 - protein, 20 aa, Artificial
  Peptide with targeting and/or antimicrobial activity
GKVSVLTRVPRSLGGAPANQ

SEQ ID NO: 429 - protein, 8 aa, Artificial
  Peptide with targeting and/or antimicrobial activity
EIQAKGTG

SEQ ID NO: 430 - protein, 20 aa, Artificial
  Peptide with targeting and/or antimicrobial activity
EEYPARVPLSGEDVTEARRH

SEQ ID NO: 431 - protein, 14 aa, Artificial
  Peptide with targeting and/or antimicrobial activity
VGYFIWKDSHSRKG

SEQ ID NO: 432 - protein, 12 aa, Artificial
  Peptide with targeting and/or antimicrobial activity
GILARADCSQIA

SEQ ID NO: 433 - protein, 22 aa, Artificial
  Peptide with targeting and/or antimicrobial activity
GIKKSKHPSTDDYVVKTTIDSL

SEQ ID NO: 434 - protein, 15 aa, Artificial
  Peptide with targeting and/or antimicrobial activity
GRYGDDSKERQGRAQ

SEQ ID NO: 435 - protein, 15 aa, Artificial
  Peptide with targeting and/or antimicrobial activity
LITAEQPATAPIAGK

SEQ ID NO: 436 - protein, 22 aa, Artificial
  Peptide with targeting and/or antimicrobial activity
HTAVVWLAGVSGCVALSHCEPA

SEQ ID NO: 437 - protein, 12 aa, Artificial
  Peptide with targeting and/or antimicrobial activity
VRLESRPADLPE

SEQ ID NO: 438 - protein, 20 aa, Artificial
  Peptide with targeting and/or antimicrobial activity
TMAFVEKAQLRVPVGDDLPV

SEQ ID NO: 439 - protein, 17 aa, Artificial
  Peptide with targeting and/or antimicrobial activity
SFHASLTKNEKPIKSTG

SEQ ID NO: 440 - protein, 18 aa, Artificial
  Peptide with targeting and/or antimicrobial activity
RGRALASTATTRPARRRR

SEQ ID NO: 441 - protein, 23 aa, Artificial
  Peptide with targeting and/or antimicrobial activity
GIRRLHSVENLNREISHRMAGLR

SEQ ID NO: 442 - protein, 26 aa, Artificial
  Peptide with targeting and/or antimicrobial activity
TSWLRAAERQEIGEPTKTFGEKTTSL

SEQ ID NO: 443 - protein, 19 aa, Artificial
  Peptide with targeting and/or antimicrobial activity
EEVSRALAGIGLGLGCRIG

SEQ ID NO: 444 - protein, 28 aa, Artificial
  Peptide with targeting and/or antimicrobial activity
GPVSVVASLRRGTTVQRHSQNNHNKGKP

SEQ ID NO: 445 - protein, 10 aa, Artificial
  Peptide with targeting and/or antimicrobial activity
SKAVSRKRSI

SEQ ID NO: 446 - protein, 20 aa, Artificial
  Peptide with targeting and/or antimicrobial activity
AIEGVIKKGACFKLLRHEMF

SEQ ID NO: 447 - protein, 28 aa, Artificial
  Peptide with targeting and/or antimicrobial activity
VLPFPAIPLSRRRACVAAPRPRSRQRAS

SEQ ID NO: 448 - protein, 15 aa, Artificial
  Peptide with targeting and/or antimicrobial activity
APGSAADSPRSRADD

SEQ ID NO: 449 - protein, 15 aa, Artificial
  Peptide with targeting and/or antimicrobial activity
RLARGRPTNLCGRRG

SEQ ID NO: 450 - protein, 9 aa, Artificial
  Peptide with targeting and/or antimicrobial activity
TQVTLCRTW

SEQ ID NO: 451 - protein, 21 aa, Artificial
  Peptide with targeting and/or antimicrobial activity
LTGVRRPWRAPWAGTSGWALR

SEQ ID NO: 452 - protein, 11 aa, Artificial
  Peptide with targeting and/or antimicrobial activity
AGRTAIVQGGG

SEQ ID NO: 453 - protein, 20 aa, Artificial
  Peptide with targeting and/or antimicrobial activity
RGGDSPARRRPGLAGPGGPG

SEQ ID NO: 454 - protein, 19 aa, Artificial
  Peptide with targeting and/or antimicrobial activity
RRRPAGQRPEKASQAMIAA

SEQ ID NO: 455 - protein, 19 aa, Artificial
  Peptide with targeting and/or antimicrobial activity
RLTSNQFLTRITPFVFAQH

SEQ ID NO: 456 - protein, 21 aa, Artificial
  Peptide with targeting and/or antimicrobial activity
VTSEPGIAHDIRLLPRAAAFR

SEQ ID NO: 457 - protein, 17 aa, Artificial
  Peptide with targeting and/or antimicrobial activity
EVYSSPTNNVAITVQNN

SEQ ID NO: 458 - protein, 13 aa, Artificial
  Peptide with targeting and/or antimicrobial activity
SGLGDLGFSSEAK

SEQ ID NO: 459 - protein, 15 aa, Artificial
  Peptide with targeting and/or antimicrobial activity
GIAPRRNEWGAVGGR

SEQ ID NO: 460 - protein, 18 aa, Artificial
  Peptide with targeting and/or antimicrobial activity
LPATRDKTRVPASVAGAP

SEQ ID NO: 461 - protein, 10 aa, Artificial
  Peptide with targeting and/or antimicrobial activity
KPGISVENRQ

SEQ ID NO: 462 - protein, 9 aa, Artificial
  Peptide with targeting and/or antimicrobial activity
LIADRHIRA

SEQ ID NO: 463 - protein, 20 aa, Artificial
  Peptide with targeting and/or antimicrobial activity
RPAQARQGPGGLIADRHIRA

SEQ ID NO: 464 - protein, 20 aa, Artificial
  Peptide with targeting and/or antimicrobial activity
DADKNLSLERDRFAWRVAAP

SEQ ID NO: 465 - protein, 26 aa, Artificial
  Peptide with targeting and/or antimicrobial activity
EIQKIAKGVSGQVYGPSRQITISKKR

SEQ ID NO: 466 - protein, 22 aa, Artificial
  Peptide with targeting and/or antimicrobial activity
ARTFAGRLGTRYFGGLMRSTKA

SEQ ID NO: 467 - protein, 14 aa, Artificial
  Peptide with targeting and/or antimicrobial activity
GNLTRSREAARATQ

SEQ ID NO: 468 - protein, 23 aa, Artificial
  Peptide with targeting and/or antimicrobial activity
HFILRKPLLFMIHSLKTGPLDRF

SEQ ID NO: 469 - protein, 21 aa, Artificial
  Peptide with targeting and/or antimicrobial activity
QFCNFAWLFLASNNAQVSALA

SEQ ID NO: 470 - protein, 11 aa, Artificial
  Peptide with targeting and/or antimicrobial activity
VEEDEAPPPHY

SEQ ID NO: 471 - protein, 14 aa, Artificial
  Peptide with targeting and/or antimicrobial activity
PPHCPPGHAKKGWC

SEQ ID NO: 472 - protein, 21 aa, Artificial
  Peptide with targeting and/or antimicrobial activity
MKGNKLATAHEQPVKNSAPPL

SEQ ID NO: 473 - protein, 18 aa, Artificial
  Peptide with targeting and/or antimicrobial activity
EMAEGSADDRLRKTPRDC

SEQ ID NO: 474 - protein, 20 aa, Artificial
  Peptide with targeting and/or antimicrobial activity
TTARYIRRQCHTSITPLSQG

SEQ ID NO: 475 - protein, 14 aa, Artificial
  Peptide with targeting and/or antimicrobial activity
CNALLRRGHPPSAL

SEQ ID NO: 476 - protein, 18 aa, Artificial
  Peptide with targeting and/or antimicrobial activity
GIELKSLIMAQIERWRQA

SEQ ID NO: 477 - protein, 15 aa, Artificial
  Peptide with targeting and/or antimicrobial activity
GCRPASLSDADPDGR

SEQ ID NO: 478 - protein, 13 aa, Artificial
  Peptide with targeting and/or antimicrobial activity
ALNRASLRLALGE

SEQ ID NO: 479 - protein, 9 aa, Artificial
  Peptide with targeting and/or antimicrobial activity
SWKCHHLAI

SEQ ID NO: 480 - protein, 23 aa, Artificial
  Peptide with targeting and/or antimicrobial activity
ALQKQDMNLPSVKNQLVFLKSTG

SEQ ID NO: 481 - protein, 16 aa, Artificial
  Peptide with targeting and/or antimicrobial activity
AGVLETPRCRGEYGAN

SEQ ID NO: 482 - protein, 24 aa, Artificial
  Peptide with targeting and/or antimicrobial activity
KLRSASKKSLQEKSCGIMPEKPAG

SEQ ID NO: 483 - protein, 18 aa, Artificial
  Peptide with targeting and/or antimicrobial activity
AAGCRDLGSLSSLVTNPS

SEQ ID NO: 484 - protein, 23 aa, Artificial
  Peptide with targeting and/or antimicrobial activity
DAYHCHLVRSPDAHDLSMRIGFV

SEQ ID NO: 485 - protein, 8 aa, Artificial
  Peptide with targeting and/or antimicrobial activity
NYAVVSHT

SEQ ID NO: 486 - protein, 12 aa, Artificial
  Peptide with targeting and/or antimicrobial activity
EREDGCDAMPLP

SEQ ID NO: 487 - protein, 26 aa, Artificial
  Peptide with targeting and/or antimicrobial activity
DSFDSLSPFRERGGEREDGCDAMPLP

SEQ ID NO: 488 - protein, 7 aa, Artificial
  Peptide with targeting and/or antimicrobial activity
NDSKASN

SEQ ID NO: 489 - protein, 12 aa, Artificial
  Peptide with targeting and/or antimicrobial activity
MTTGVDFIIEKV

SEQ ID NO: 490 - protein, 23 aa, Artificial
  Peptide with targeting and/or antimicrobial activity
GHLRVCWVFSASLLTPFRSATLI

SEQ ID NO: 491 - protein, 25 aa, Artificial
  Peptide with targeting and/or antimicrobial activity
ELKITNYNVNTVLYRYYKWGNDLCE

SEQ ID NO: 492 - protein, 20 aa, Artificial
  Peptide with targeting and/or antimicrobial activity
ESVDKITEALEEDGFPAKVQ

SEQ ID NO: 493 - protein, 13 aa, Artificial
  Peptide with targeting and/or antimicrobial activity
DWEFTHKTIPQKK

SEQ ID NO: 494 - protein, 21 aa, Artificial
  Peptide with targeting and/or antimicrobial activity
SETPEKPVGTFFYSIYYKIIL

SEQ ID NO: 495 - protein, 23 aa, Artificial
  Peptide with targeting and/or antimicrobial activity
FLALAVIAGLFKVILIYAAPYLK

SEQ ID NO: 496 - protein, 9 aa, Artificial
  Peptide with targeting and/or antimicrobial activity
VFDNIDINF

SEQ ID NO: 497 - protein, 6 aa, Artificial
  Peptide with targeting and/or antimicrobial activity
HIKETR

SEQ ID NO: 498 - protein, 16 aa, Artificial
  Peptide with targeting and/or antimicrobial activity
VKFCIECQTKLERKRR

SEQ ID NO: 499 - protein, 13 aa, Artificial
  Peptide with targeting and/or antimicrobial activity
DYFYITLSQKNTF

SEQ ID NO: 500 - protein, 16 aa, Artificial
  Peptide with targeting and/or antimicrobial activity
MNCASPEFKKLMELYK

SEQ ID NO: 501 - protein, 38 aa, Artificial
  Peptide with targeting and/or antimicrobial activity
LMFFSENMDKRDTLSGKFRYFAGSKVIKLMNWLSENGK

SEQ ID NO: 502 - protein, 11 aa, Artificial
  Peptide with targeting and/or antimicrobial activity
NQLGSQAFAQL

SEQ ID NO: 503 - protein, 32 aa, Artificial
  Peptide with targeting and/or antimicrobial activity
DPILIQIGFTRFALRKAEAEKIEIQVEEGVPA

SEQ ID NO: 504 - protein, 17 aa, Artificial
  Peptide with targeting and/or antimicrobial activity
EDKPTNTIQEIKPVKWQ

SEQ ID NO: 505 - protein, 38 aa, Artificial
  Peptide with targeting and/or antimicrobial activity
AVRDFKKSVREEDEAASLNSPRTIDAQVKTSESTSVKS

SEQ ID NO: 506 - protein, 18 aa, Artificial
  Peptide with targeting and/or antimicrobial activity
FDQLYALEREGKLDELLA

SEQ ID NO: 507 - protein, 27 aa, Artificial
  Peptide with targeting and/or antimicrobial activity
DANAMARTTIAIVYILALIALTISYSL

SEQ ID NO: 508 - protein, 8 aa, Artificial
  Peptide with targeting and/or antimicrobial activity
RTPYILRS

SEQ ID NO: 509 - protein, 32 aa, Artificial
  Peptide with targeting and/or antimicrobial activity
GIPFSKPHKRQVNYMKSDVLAYIEQNKMAHTA

SEQ ID NO: 510 - protein, 28 aa, Artificial
  Peptide with targeting and/or antimicrobial activity
KEIRTATVAELNAKRRLTSAEQALAEVS

SEQ ID NO: 511 - protein, 10 aa, Artificial
  Peptide with targeting and/or antimicrobial activity
YVKPKVGVHE

SEQ ID NO: 512 - protein, 40 aa, Artificial
  Peptide with targeting and/or antimicrobial activity
RNAVVVTEATFPKYEEEITNYLNRRFGEDWSLKLEKCSVA

SEQ ID NO: 513 - protein, 17 aa, Artificial
  Peptide with targeting and/or antimicrobial activity
PKHNVVTGVSVDLDYKP

SEQ ID NO: 514 - protein, 13 aa, Artificial
  Peptide with targeting and/or antimicrobial activity
RITEVPPDEHSDR

SEQ ID NO: 515 - protein, 33 aa, Artificial
  Peptide with targeting and/or antimicrobial activity
KLFEDPLIKSKAVENFQTTWHEQCLAKELAKNM

SEQ ID NO: 516 - protein, 27 aa, Artificial
  Peptide with targeting and/or antimicrobial activity
HMRTISYLLAFAKFSLFIPPKQSLKRL

SEQ ID NO: 517 - protein, 41 aa, Artificial
  Peptide with targeting and/or antimicrobial activity
MNDVKPVVQPKQTLKAFLVQLLSVRAGVYIKQNNQLPKTKG

SEQ ID NO: 518 - protein, 32 aa, Artificial
  Peptide with targeting and/or antimicrobial activity
QPDEKAEFFDPSLDKVYRHPTFYHIPDGIEHM

SEQ ID NO: 519 - protein, 8 aa, Artificial
  Peptide with targeting and/or antimicrobial activity
ETAASETH

SEQ ID NO: 520 - protein, 30 aa, Artificial
  Peptide with targeting and/or antimicrobial activity
ILSKLWFWMINSLGVVLLVSYWLLAKWGVA

SEQ ID NO: 521 - protein, 9 aa, Artificial
  Peptide with targeting and/or antimicrobial activity
INSRYKISF

SEQ ID NO: 522 - protein, 40 aa, Artificial
  Peptide with targeting and/or antimicrobial activity
MKKLVAALAVIVILTGCVYDPVNYDKIHDQEFQDHLRQNG

SEQ ID NO: 523 - protein, 6 aa, Artificial
  Peptide with targeting and/or antimicrobial activity
VRDDDS

SEQ ID NO: 524 - protein, 37 aa, Artificial
  Peptide with targeting and/or antimicrobial activity
FIYGVGFVPHFWLWKWLFSPWIAWPLMLLGYYIWFLT

SEQ ID NO: 525 - protein, 24 aa, Artificial
  Peptide with targeting and/or antimicrobial activity
DHKINESQHNPFRSDSNKQNVDFF

SEQ ID NO: 526 - protein, 39 aa, Artificial
  Peptide with targeting and/or antimicrobial activity
EYFKQVYVKNEKIYSFWICKDLSPKEAAKRAEDILVKLK

SEQ ID NO: 527 - protein, 38 aa, Artificial
  Peptide with targeting and/or antimicrobial activity
VWENRKKYLENEIERHNVFLKLGQEVIKGLNALASRGR

SEQ ID NO: 528 - protein, 35 aa, Artificial
  Peptide with targeting and/or antimicrobial activity
LPFSKIGRRVSYKKKDVLKYEQSKTVLNTAQLATV

SEQ ID NO: 529 - protein, 36 aa, Artificial
  Peptide with targeting and/or antimicrobial activity
DPHSEIDVTRYCQLHHFTCQTMQISEREFHYLIETQ

SEQ ID NO: 530 - protein, 7 aa, Artificial
  Peptide with targeting and/or antimicrobial activity
NLKKCPC

SEQ ID NO: 531 - protein, 41 aa, Artificial
  Peptide with targeting and/or antimicrobial activity
MKTLFFPLFLIIFVLIIQALDQSYQKKIGISKPQKHPEFMQ

SEQ ID NO: 532 - protein, 14 aa, Artificial
  Peptide with targeting and/or antimicrobial activity
DQEKKNKTEESTEQ

SEQ ID NO: 533 - protein, 7 aa, Artificial
  Peptide with targeting and/or antimicrobial activity
SDDKRTD

SEQ ID NO: 534 - protein, 15 aa, Artificial
  Peptide with targeting and/or antimicrobial activity
EVLLSDLRPDIFSET

SEQ ID NO: 535 - protein, 42 aa, Artificial
  Peptide with targeting and/or antimicrobial activity
MYLTPYAWIAVGSIFAFSVTTIKIGDQNDEKQKSHKNDVHKR

SEQ ID NO: 536 - protein, 9 aa, Artificial
  Peptide with targeting and/or antimicrobial activity
AAQPQTTSP

SEQ ID NO: 537 - protein, 23 aa, Artificial
  Peptide with targeting and/or antimicrobial activity
LVGALLIFVALIYMVLKGNADKN

SEQ ID NO: 538 - protein, 41 aa, Artificial
  Peptide with targeting and/or antimicrobial activity
LVSGVANTVKNTAHTVGNTAKHAGHVAADTTVKATKKQQVK

SEQ ID NO: 539 - protein, 17 aa, Artificial
  Peptide with targeting and/or antimicrobial activity
LDLALSTNSLNLEGFSF

SEQ ID NO: 540 - protein, 24 aa, Artificial
  Peptide with targeting and/or antimicrobial activity
LSLATFAKIFMTRSNWSLKRFNRL

SEQ ID NO: 541 - protein, 31 aa, Artificial
  Peptide with targeting and/or antimicrobial activity
SHIGFISISACLAVLLGIARLFVWTWVKFFA

SEQ ID NO: 542 - protein, 19 aa, Artificial
  Peptide with targeting and/or antimicrobial activity
SYNTYYNKLIHGQRTPDGM

SEQ ID NO: 543 - protein, 18 aa, Artificial
  Peptide with targeting and/or antimicrobial activity
QNNDTSAWCGSAHKNGNS

SEQ ID NO: 544 - protein, 30 aa, Artificial
  Peptide with targeting and/or antimicrobial activity
MIRIRSPTKKKLNRNSISDWKSNTSGRFFY

SEQ ID NO: 545 - protein, 21 aa, Artificial
  Peptide with targeting and/or antimicrobial activity
MRYITYSLIPRLLSKKVIHQQ

SEQ ID NO: 546 - protein, 14 aa, Artificial
  Peptide with targeting and/or antimicrobial activity
VPAKLLRVIDEIPE

SEQ ID NO: 547 - protein, 13 aa, Artificial
  Peptide with targeting and/or antimicrobial activity
IYQLLNIEYSEDD

SEQ ID NO: 548 - protein, 30 aa, Artificial
  Peptide with targeting and/or antimicrobial activity
MGRHLWNPSYFVATVSENTEEQIRKYRKNK

SEQ ID NO: 549 - protein, 10 aa, Artificial
  Peptide with targeting and/or antimicrobial activity
DVDGAIESEL

SEQ ID NO: 550 - protein, 19 aa, Artificial
  Peptide with targeting and/or antimicrobial activity
SFVSTTVRLIFEESKRYKF

SEQ ID NO: 551 - protein, 21 aa, Artificial
  Peptide with targeting and/or antimicrobial activity
DFLVNFLWFKGELNWGKKRYK

SEQ ID NO: 552 - protein, 32 aa, Artificial
  Peptide with targeting and/or antimicrobial activity
NIQVYESECGNYIFKKSDESFLIDIFDKNGTH

SEQ ID NO: 553 - protein, 28 aa, Artificial
  Peptide with targeting and/or antimicrobial activity
ISKGIDDIVYVINKILSIGNIFKIIKRK

SEQ ID NO: 554 - protein, 14 aa, Artificial
  Peptide with targeting and/or antimicrobial activity
LATKLKYEKEHKKM

SEQ ID NO: 555 - protein, 15 aa, Artificial
  Peptide with targeting and/or antimicrobial activity
VKDVLLELFNKIIGA

SEQ ID NO: 556 - protein, 18 aa, Artificial
  Peptide with targeting and/or antimicrobial activity
GIVLIGLKLIPLLANVLN

SEQ ID NO: 557 - protein, 33 aa, Artificial
  Peptide with targeting and/or antimicrobial activity
LVKDTSDIKNDLNNIEIVTSKNSNDIAKLKSVK

SEQ ID NO: 558 - protein, 36 aa, Artificial
  Peptide with targeting and/or antimicrobial activity
MREWICPSCNETHDRDINASINILKEGLRLITIQNK

SEQ ID NO: 559 - protein, 28 aa, Artificial
  Peptide with targeting and/or antimicrobial activity
GCILPHKKDNYNYIMSKFQDLVKITSKK

SEQ ID NO: 560 - protein, 37 aa, Artificial
  Peptide with targeting and/or antimicrobial activity
MKRRRCNWCGKLFYLEEKSKEAYCCKECRKKAKKVKK

SEQ ID NO: 561 - protein, 9 aa, Artificial
  Peptide with targeting and/or antimicrobial activity
QQYLILDRM

SEQ ID NO: 562 - protein, 22 aa, Artificial
  Peptide with targeting and/or antimicrobial activity
GIPGMTAAPAEENEQEENADEE

SEQ ID NO: 563 - protein, 26 aa, Artificial
  Peptide with targeting and/or antimicrobial activity
IDAVTKKKTTCMIRAPTKIPIAHTDN

SEQ ID NO: 564 - protein, 32 aa, Artificial
  Peptide with targeting and/or antimicrobial activity
YITSHKNARAIIKKFERDEILEEVITHYLNRK

SEQ ID NO: 565 - protein, 37 aa, Artificial
  Peptide with targeting and/or antimicrobial activity
ECLKKAIKSKALNKAFKIDVPDEVYDNLLMELEEYEK

SEQ ID NO: 566 - protein, 7 aa, Artificial
  Peptide with targeting and/or antimicrobial activity
LILVSDI

SEQ ID NO: 567 - protein, 41 aa, Artificial
  Peptide with targeting and/or antimicrobial activity
SIGSMIGMYSFRHKTKHIKFTFGIPFILFLQFLLVYFYILK

SEQ ID NO: 568 - protein, 40 aa, Artificial
  Peptide with targeting and/or antimicrobial activity
DSGYYALLENKEERVVWDGEVVANNIFNNLWIVVNKVKTG

SEQ ID NO: 569 - protein, 28 aa, Artificial
  Peptide with targeting and/or antimicrobial activity
ARESIEKSHVPVDATIVGVVDSFEVFDE

SEQ ID NO: 570 - protein, 5 aa, Artificial
  Peptide with targeting and/or antimicrobial activity
HFSLL

SEQ ID NO: 571 - protein, 11 aa, Artificial
  Peptide with targeting and/or antimicrobial activity
LTIDEKLRNHR

SEQ ID NO: 572 - protein, 38 aa, Artificial
  Peptide with targeting and/or antimicrobial activity
VIVGNLGAQKEKRNDTPISAKKDIMGDKTVRVRADLHH

SEQ ID NO: 573 - protein, 15 aa, Artificial
  Peptide with targeting and/or antimicrobial activity
NGNEKAFSEVENLVK

SEQ ID NO: 574 - protein, 12 aa, Artificial
  Peptide with targeting and/or antimicrobial activity
IGILFDKSVRKY

SEQ ID NO: 575 - protein, 20 aa, Artificial
  Peptide with targeting and/or antimicrobial activity
YMTKKLVEMAEQQMAGKSNR

SEQ ID NO: 576 - protein, 9 aa, Artificial
  Peptide with targeting and/or antimicrobial activity
QQYLILDRM

SEQ ID NO: 577 - protein, 23 aa, Artificial
  Peptide with targeting and/or antimicrobial activity
MLTSRKKRLKKIVEEQNKKDESI

SEQ ID NO: 578 - protein, 17 aa, Artificial
  Peptide with targeting and/or antimicrobial activity
YMTKKLVEMAERQMAGK

SEQ ID NO: 579 - protein, 17 aa, Artificial
  Peptide with targeting and/or antimicrobial activity
KGTSCPDQLSKAIRQSI

SEQ ID NO: 580 - protein, 15 aa, Artificial
  Peptide with targeting and/or antimicrobial activity
VKDVLLELFNKIIGA

SEQ ID NO: 581 - protein, 22 aa, Artificial
  Peptide with targeting and/or antimicrobial activity
DERLPEAKAIRNFNGSVMVLGR

SEQ ID NO: 582 - protein, 15 aa, Artificial
  Peptide with targeting and/or antimicrobial activity
GIFTGVTVVVSLKHC

SEQ ID NO: 583 - protein, 22 aa, Artificial
  Peptide with targeting and/or antimicrobial activity
ESASAAEWYNPNMNVKKAICMG

SEQ ID NO: 584 - protein, 30 aa, Artificial
  Peptide with targeting and/or antimicrobial activity
MPKSCHVPVLCDFFFLVIIKFLALFKTIQS

SEQ ID NO: 585 - protein, 10 aa, Artificial
  Peptide with targeting and/or antimicrobial activity
LAVILRAIVY

SEQ ID NO: 586 - protein, 21 aa, Artificial
  Peptide with targeting and/or antimicrobial activity
YLFFKGKKVAEEEATKDEVKR

SEQ ID NO: 587 - protein, 6 aa, Artificial
  Peptide with targeting and/or antimicrobial activity
RVKKIG

SEQ ID NO: 588 - protein, 20 aa, Artificial
  Peptide with targeting and/or antimicrobial activity
EKTNFKGVKRNFYKKASFFV

SEQ ID NO: 589 - protein, 19 aa, Artificial
  Peptide with targeting and/or antimicrobial activity
FTFSKCRASNGRGFGTLWL

SEQ ID NO: 590 - protein, 15 aa, Artificial
  Peptide with targeting and/or antimicrobial activity
WIAIGLLLYFSLKNQ

SEQ ID NO: 591 - protein, 21 aa, Artificial
  Peptide with targeting and/or antimicrobial activity
VSIKIGAIVIGMIGLMELLTE

SEQ ID NO: 592 - protein, 30 aa, Artificial
  Peptide with targeting and/or antimicrobial activity
MLTIIIGFIFWTMTLMLGYLIGEREGRKHE

SEQ ID NO: 593 - protein, 13 aa, Artificial
  Peptide with targeting and/or antimicrobial activity
RNTAHNIKWRSKN

SEQ ID NO: 594 - protein, 30 aa, Artificial
  Peptide with targeting and/or antimicrobial activity
MTVMEDPGSEQRNKIQSPMKGEDFSALFGR

SEQ ID NO: 595 - protein, 30 aa, Artificial
  Peptide with targeting and/or antimicrobial activity
MEQKVKVIFVPRSKPDNQLKTFVSAVLFKA

SEQ ID NO: 596 - protein, 12 aa, Artificial
  Peptide with targeting and/or antimicrobial activity
NQVTEGIRLLVE

SEQ ID NO: 597 - protein, 17 aa, Artificial
  Peptide with targeting and/or antimicrobial activity
NIERILKEKVWMIRCVE

SEQ ID NO: 598 - protein, 25 aa, Artificial
  Peptide with targeting and/or antimicrobial activity
SMLSVTVMCLMHASVAANQAMEKKV

SEQ ID NO: 599 - protein, 7 aa, Artificial
  Peptide with targeting and/or antimicrobial activity
LVNGIKI

SEQ ID NO: 600 - protein, 20 aa, Artificial
  Peptide with targeting and/or antimicrobial activity
LYKQKIQLEEELEKLKDDRQ

SEQ ID NO: 601 - protein, 19 aa, Artificial
  Peptide with targeting and/or antimicrobial activity
ALCSVIKAIELGIINVHLQ

SEQ ID NO: 602 - protein, 20 aa, Artificial
  Peptide with targeting and/or antimicrobial activity
TKTPGTFTPGTGIQKTAVPL

SEQ ID NO: 603 - protein, 6 aa, Artificial
  Peptide with targeting and/or antimicrobial activity
MLKQTA

SEQ ID NO: 604 - protein, 30 aa, Artificial
  Peptide with targeting and/or antimicrobial activity
MSEAVNLLRGARYSQRYAKNQVPYEVIIEK

SEQ ID NO: 605 - protein, 16 aa, Artificial
  Peptide with targeting and/or antimicrobial activity
VIFLHKESGNLKEIFY

SEQ ID NO: 606 - protein, 7 aa, Artificial
  Peptide with targeting and/or antimicrobial activity
TFIYNEF

SEQ ID NO: 607 - protein, 18 aa, Artificial
  Peptide with targeting and/or antimicrobial activity
KKQDKRIEDKYKRMKKGD

SEQ ID NO: 608 - protein, 8 aa, Artificial
  Peptide with targeting and/or antimicrobial activity
HFYLLFER

SEQ ID NO: 609 - protein, 20 aa, Artificial
  Peptide with targeting and/or antimicrobial activity
HLFFVKGMFILCQKNQINDE

SEQ ID NO: 610 - protein, 30 aa, Artificial
  Peptide with targeting and/or antimicrobial activity
MDSAKAQTMRTDWLAVSCLVASAYLRSMLA

SEQ ID NO: 611 - protein, 27 aa, Artificial
  Peptide with targeting and/or antimicrobial activity
MTVFEALMLAIAFATLIVKISNKNDKK

SEQ ID NO: 612 - protein, 21 aa, Artificial
  Peptide with targeting and/or antimicrobial activity
ESAKSNLNFLMQEEWALFLLL

SEQ ID NO: 613 - protein, 23 aa, Artificial
  Peptide with targeting and/or antimicrobial activity
VFVVLFIIYLASKLLTKLFPIKK

SEQ ID NO: 614 - protein, 16 aa, Artificial
  Peptide with targeting and/or antimicrobial activity
KKIIPLITLFVVTLVG

SEQ ID NO: 615 - protein, 24 aa, Artificial
  Peptide with targeting and/or antimicrobial activity
QGANPCQQVGFTVNDPDCRLAKTV

SEQ ID NO: 616 - protein, 21 aa, Artificial
  Peptide with targeting and/or antimicrobial activity
KYKCSWCKRVYTLRKDHKTAR

SEQ ID NO: 617 - protein, 12 aa, Artificial
  Peptide with targeting and/or antimicrobial activity
WSEIEINTKQSN

SEQ ID NO: 618 - protein, 10 aa, Artificial
  Peptide with targeting and/or antimicrobial activity
HISKERFEAY

SEQ ID NO: 619 - protein, 25 aa, Artificial
  Peptide with targeting and/or antimicrobial activity
MIKKSILKIKYYVPVLISLTLILSA

SEQ ID NO: 620 - protein, 20 aa, Artificial
  Peptide with targeting and/or antimicrobial activity
FTLTLITTIVAILNYKDKKK

SEQ ID NO: 621 - protein, 29 aa, Artificial
  Peptide with targeting and/or antimicrobial activity
GAVGIAFFAGNMKQDKRIADRQNKKSEKK

SEQ ID NO: 622 - protein, 18 aa, Artificial
  Peptide with targeting and/or antimicrobial activity
ITPLLDEIGKVCIDKISK

SEQ ID NO: 623 - protein, 36 aa, Artificial
  Peptide with targeting and/or antimicrobial activity
GLQFKEIAEEFHITTTALQQWHKDNGYPIYNKNNRK

SEQ ID NO: 624 - protein, 14 aa, Artificial
  Peptide with targeting and/or antimicrobial activity
VVAYVITQVGAIRF

SEQ ID NO: 625 - protein, 14 aa, Artificial
  Peptide with targeting and/or antimicrobial activity
DPAGCNDIVRKYCK

SEQ ID NO: 626 - protein, 14 aa, Artificial
  Peptide with targeting and/or antimicrobial activity
DLVQSILSEFKKSG

SEQ ID NO: 627 - protein, 10 aa, Artificial
  Peptide with targeting and/or antimicrobial activity
VLKEECYQKN

SEQ ID NO: 628 - protein, 16 aa, Artificial
  Peptide with targeting and/or antimicrobial activity
YCVPLGNMGNMNNKIW

SEQ ID NO: 629 - protein, 28 aa, Artificial
  Peptide with targeting and/or antimicrobial activity
LIYTILASLGVLTVLQAILGREPKAVKA

SEQ ID NO: 630 - protein, 10 aa, Artificial
  Peptide with targeting and/or antimicrobial activity
VEDLMEDLNA

SEQ ID NO: 631 - protein, 25 aa, Artificial
  Peptide with targeting and/or antimicrobial activity
ILVVLAGILLVVLSYVGISKFKMNC

SEQ ID NO: 632 - protein, 25 aa, Artificial
  Peptide with targeting and/or antimicrobial activity
FPIISALLGAIICIAIYSFIVNRKA

SEQ ID NO: 633 - protein, 15 aa, Artificial
  Peptide with targeting and/or antimicrobial activity
VIAWKFRNKFENSGV

SEQ ID NO: 634 - protein, 25 aa, Artificial
  Peptide with targeting and/or antimicrobial activity
YWLSRVTTGHSFAFEKPVPLSLTIK

SEQ ID NO: 635 - protein, 14 aa, Artificial
  Peptide with targeting and/or antimicrobial activity
FIDVLKSKINEFLN

SEQ ID NO: 636 - protein, 25 aa, Artificial
  Peptide with targeting and/or antimicrobial activity
LLSTEQLLKYYDGETFDGFQLPSNE

SEQ ID NO: 637 - protein, 9 aa, Artificial
  Peptide with targeting and/or antimicrobial activity
VLYFQATVV

SEQ ID NO: 638 - protein, 18 aa, Artificial
  Peptide with targeting and/or antimicrobial activity
LVRIEVDDLEEWYERNFI

SEQ ID NO: 639 - protein, 27 aa, Artificial
  Peptide with targeting and/or antimicrobial activity
YLEMNADYLSNMDIFDELWEKYLENNK

SEQ ID NO: 640 - protein, 20 aa, Artificial
  Peptide with targeting and/or antimicrobial activity
KPKNKKEKTVISYEKLLSMY

SEQ ID NO: 641 - protein, 16 aa, Artificial
  Peptide with targeting and/or antimicrobial activity
YCVPLGNMGNMNNKIW

SEQ ID NO: 642 - protein, 14 aa, Artificial
  Peptide with targeting and/or antimicrobial activity
DLVQSILSEFKKSG

SEQ ID NO: 643 - protein, 18 aa, Artificial
  Peptide with targeting and/or antimicrobial activity
FALELIALCRNLFIVYFP

SEQ ID NO: 644 - protein, 17 aa, Artificial
  Peptide with targeting and/or antimicrobial activity
WVAVAILLNIALQTQLT

SEQ ID NO: 645 - protein, 10 aa, Artificial
  Peptide with targeting and/or antimicrobial activity
TSGWLGQLEQ

SEQ ID NO: 646 - protein, 22 aa, Artificial
  Peptide with targeting and/or antimicrobial activity
TFAGSIKIGVPDLVHVTFNCKR

SEQ ID NO: 647 - protein, 7 aa, Artificial
  Peptide with targeting and/or antimicrobial activity
LLNKKLE

SEQ ID NO: 648 - protein, 16 aa, Artificial
  Peptide with targeting and/or antimicrobial activity
SKAGLYGKIERSDKRE

SEQ ID NO: 649 - protein, 6 aa, Artificial
  Peptide with targeting and/or antimicrobial activity
DSYFRS

SEQ ID NO: 650 - protein, 22 aa, Artificial
  Peptide with targeting and/or antimicrobial activity
FFLVHFYIRKRKGKVSIFLNYF

SEQ ID NO: 651 - protein, 13 aa, Artificial
  Peptide with targeting and/or antimicrobial activity
KHCFEITDKTDVV

SEQ ID NO: 652 - protein, 30 aa, Artificial
  Peptide with targeting and/or antimicrobial activity
MSRKKYENDEKSQKKLKIGRKSDVFYGIID

SEQ ID NO: 653 - protein, 21 aa, Artificial
  Peptide with targeting and/or antimicrobial activity
AGKKERLLSFREQFLNKNKKK

SEQ ID NO: 654 - protein, 17 aa, Artificial
  Peptide with targeting and/or antimicrobial activity
IAAFVTSRAFSDTVSPI

SEQ ID NO: 655 - protein, 30 aa, Artificial
  Peptide with targeting and/or antimicrobial activity
MMELVLKTIIGPIVVGVVLRIVDKWLNKDK

SEQ ID NO: 656 - protein, 30 aa, Artificial
  Peptide with targeting and/or antimicrobial activity
MLQKYTQMISVTKCIITKNKKTQENVDAYN

SEQ ID NO: 657 - protein, 20 aa, Artificial
  Peptide with targeting and/or antimicrobial activity
YVLEYHGLRATQDVDAFMAL

SEQ ID NO: 658 - protein, 7 aa, Artificial
  Peptide with targeting and/or antimicrobial activity
ENEESIF

SEQ ID NO: 659 - protein, 15 aa, Artificial
  Peptide with targeting and/or antimicrobial activity
AATLICVGSGIMSSL

SEQ ID NO: 660 - protein, 13 aa, Artificial
  Peptide with targeting and/or antimicrobial activity
AVVCGYLAYTATS

SEQ ID NO: 661 - protein, 9 aa, Artificial
  Peptide with targeting and/or antimicrobial activity
VAYAAICWW

SEQ ID NO: 662 - protein, 13 aa, Artificial
  Peptide with targeting and/or antimicrobial activity
FNGDSEFFLCIAF

SEQ ID NO: 663 - protein, 27 aa, Artificial
  Peptide with targeting and/or antimicrobial activity
MRKEFHNVLSSGQLLADKRPARDYNRK

SEQ ID NO: 664 - protein, 16 aa, Artificial
  Peptide with targeting and/or antimicrobial activity
GQLLADKRPARDYNRK

SEQ ID NO: 665 - protein, 30 aa, Artificial
  Peptide with targeting and/or antimicrobial activity
MSRWDGHSDKGEAPAGKPPMHGFGLNGENK

SEQ ID NO: 666 - protein, 13 aa, Artificial
  Peptide with targeting and/or antimicrobial activity
KKHVLVGKQEKNG

SEQ ID NO: 667 - protein, 24 aa, Artificial
  Peptide with targeting and/or antimicrobial activity
QPYFQNQFKKITGYTPLQYRKEKR

SEQ ID NO: 668 - protein, 25 aa, Artificial
  Peptide with targeting and/or antimicrobial activity
RVLVLKKFHGIMDGNRNVAVFFVGQ

SEQ ID NO: 669 - protein, 30 aa, Artificial
  Peptide with targeting and/or antimicrobial activity
MFIISPDLFNIAVILYILFFIHDILLLILS

SEQ ID NO: 670 - protein, 20 aa, Artificial
  Peptide with targeting and/or antimicrobial activity
TQVHKMARGIDPGPANGIYR

SEQ ID NO: 671 - protein, 30 aa, Artificial
  Peptide with targeting and/or antimicrobial activity
MQIFYIKTKIFLSFFLFLLIFSQCFYKIEE

SEQ ID NO: 672 - protein, 21 aa, Artificial
  Peptide with targeting and/or antimicrobial activity
KLLYFFNYFENLQQVHLLVQL

SEQ ID NO: 673 - protein, 30 aa, Artificial
  Peptide with targeting and/or antimicrobial activity
MAAKLWEEGKMVYASSASMTKRLKLAMSKV

SEQ ID NO: 674 - protein, 14 aa, Artificial
  Peptide with targeting and/or antimicrobial activity
ASMTKRLKLAMSKV

SEQ ID NO: 675 - protein, 6 aa, Artificial
  Peptide with targeting and/or antimicrobial activity
SGNEKV

SEQ ID NO: 676 - protein, 22 aa, Artificial
  Peptide with targeting and/or antimicrobial activity
IDKSRNKDQFSHIFGLYNICSG

SEQ ID NO: 677 - protein, 15 aa, Artificial
  Peptide with targeting and/or antimicrobial activity
SLQSQLGPCLHDQRH

SEQ ID NO: 678 - protein, 13 aa, Artificial
  Peptide with targeting and/or antimicrobial activity
HRNLIILQRTIFI

SEQ ID NO: 679 - protein, 30 aa, Artificial
  Peptide with targeting and/or antimicrobial activity
MVNYIIGSYMLYREQNNNEALRKFDITLAM

SEQ ID NO: 680 - protein, 30 aa, Artificial; identical to SEQ ID NO: 328
  Peptide with targeting and/or antimicrobial activity

SEQ ID NO: 681 - protein, 11 aa, Artificial
  Peptide with targeting and/or antimicrobial activity
IIQDIAHAFGY

SEQ ID NO: 682 - protein, 30 aa, Artificial
  Peptide with targeting and/or antimicrobial activity
MSVFVPVTNIFMFIMSPIFNVNLLHFKVYI

SEQ ID NO: 683 - protein, 9 aa, Artificial
  Peptide with targeting and/or antimicrobial activity
TCVKPRTIN

SEQ ID NO: 684 - protein, 8 aa, Artificial
  Peptide with targeting and/or antimicrobial activity
INKYHHIA

SEQ ID NO: 685 - protein, 25 aa, Artificial
  Peptide with targeting and/or antimicrobial activity
ISLIIFIMLFVVALFKCITNYKHQS

SEQ ID NO: 686 - protein, 16 aa, Artificial
  Peptide with targeting and/or antimicrobial activity
EKRMSFNENQSHRPLL

SEQ ID NO: 687 - protein, 30 aa, Artificial
  Peptide with targeting and/or antimicrobial activity
MEHVLPFQNTPPNIVIIYKDFTHLKSITFS

SEQ ID NO: 688 - protein, 30 aa, Artificial
  Peptide with targeting and/or antimicrobial activity
MTLAIKNCSVTKCLGFGDFVNDDSDSYFDA

SEQ ID NO: 689 - protein, 7 aa, Artificial
  Peptide with targeting and/or antimicrobial activity
KNKTDTL

SEQ ID NO: 690 - protein, 30 aa, Artificial
  Peptide with targeting and/or antimicrobial activity
MVILVFSLIFIFTDNYLVYQSKSIKEDVMI

SEQ ID NO: 691 - protein, 10 aa, Artificial
  Peptide with targeting and/or antimicrobial activity
VDMVNRFLGN

SEQ ID NO: 692 - protein, 25 aa, Artificial
  Peptide with targeting and/or antimicrobial activity
KPVGKALEEIADGKIEPVVPKEYLG

SEQ ID NO: 693 - protein, 6 aa, Artificial
  Peptide with targeting and/or antimicrobial activity
VRKSDQ

SEQ ID NO: 694 - protein, 9 aa, Artificial
  Peptide with targeting and/or antimicrobial activity
YYKDYFKEI

SEQ ID NO: 695 - protein, 17 aa, Artificial
  Peptide with targeting and/or antimicrobial activity
YKVNYNNIDNHFNTLRH

SEQ ID NO: 696 - protein, 18 aa, Artificial
  Peptide with targeting and/or antimicrobial activity
PYSDSYATRPHWEQHRAR

SEQ ID NO: 697 - protein, 30 aa, Artificial
  Peptide with targeting and/or antimicrobial activity
MVGKIRGVTPRNDLLNANITGQLNLNYRLI

SEQ ID NO: 698 - protein, 30 aa, Artificial
  Peptide with targeting and/or antimicrobial activity
MHISHLLDEVEQTEREKAVNVLENMNGNVI

SEQ ID NO: 699 - protein, 25 aa, Artificial
  Peptide with targeting and/or antimicrobial activity
MAADIISTIGDLVKWIIDTVNKFKK

SEQ ID NO: 700 - protein, 30 aa, Artificial
  Peptide with targeting and/or antimicrobial activity
MHRNLVLVKMEPIPHIMIIANQIGIIIEKA

SEQ ID NO: 701 - protein, 30 aa, Artificial
  Peptide with targeting and/or antimicrobial activity
MREKVRFTQAFKLFWTNYFNFKGRSRRSEY

SEQ ID NO: 702 - protein, 14 aa, Artificial
  Peptide with targeting and/or antimicrobial activity
WADAQYKLCENCSE

SEQ ID NO: 703 - protein, 12 aa, Artificial
  Peptide with targeting and/or antimicrobial activity
HKNKLNIPHIKS

SEQ ID NO: 704 - protein, 20 aa, Artificial
  Peptide with targeting and/or antimicrobial activity
HLFILKSHLKPFPPFRYTYD

SEQ ID NO: 705 - protein, 12 aa, Artificial
  Peptide with targeting and/or antimicrobial activity
AYILKRREEKNK

SEQ ID NO: 706 - protein, 30 aa, Artificial
  Peptide with targeting and/or antimicrobial activity
MVEILVNTAISVYIVALYTQWLSTRDNLKA

SEQ ID NO: 707 - protein, 36 aa, Artificial
  Peptide with targeting and/or antimicrobial activity
DELYEIMDKVIEEFNKDIEQNNNNGNNEDLTENKIN

SEQ ID NO: 708 - protein, 17 aa, Artificial
  Peptide with targeting and/or antimicrobial activity
LVGYVRTSGTVRSYKIN

SEQ ID NO: 709 - protein, 12 aa, Artificial
  Peptide with targeting and/or antimicrobial activity
EDNKDKKDKKDK

SEQ ID NO: 710 - protein, 12 aa, Artificial
  Peptide with targeting and/or antimicrobial activity
HKKDIRKQVFKN

SEQ ID NO: 711 - protein, 9 aa, Artificial
  Peptide with targeting and/or antimicrobial activity
MQKEGEEDY

SEQ ID NO: 712 - protein, 30 aa, Artificial
  Peptide with targeting and/or antimicrobial activity
MYKAIAVLAMTIMAFFIFVYPFFIVGLILG

SEQ ID NO: 713 - protein, 18 aa, Artificial
  Peptide with targeting and/or antimicrobial activity
YPNEQGHHKNNLKNIIIE

SEQ ID NO: 714 - protein, 14 aa, Artificial
  Peptide with targeting and/or antimicrobial activity
KVDRVSTTITEKIK

SEQ ID NO: 715 - protein, 13 aa, Artificial
  Peptide with targeting and/or antimicrobial activity
RLILVSGNATVQK

SEQ ID NO: 716 - protein, 23 aa, Artificial
  Peptide with targeting and/or antimicrobial activity
IHQYSSKPDIVGQEAKTVQQINS

SEQ ID NO: 717 - protein, 17 aa, Artificial
  Peptide with targeting and/or antimicrobial activity
IQIDAASFYSISKSTIK

SEQ ID NO: 718 - protein, 18 aa, Artificial
  Peptide with targeting and/or antimicrobial activity
PGAFFFCRGRGCWCGIGW

SEQ ID NO: 719 - protein, 24 aa, Artificial
  Peptide with targeting and/or antimicrobial activity
FTEPLRPLQAKGQIISIKPSTSSS

SEQ ID NO: 720 - protein, 9 aa, Artificial
  Peptide with targeting and/or antimicrobial activity
KGIYKKRTY

SEQ ID NO: 721 - protein, 16 aa, Artificial
  Peptide with targeting and/or antimicrobial activity
EVTKRLVALAQQQLRG

SEQ ID NO: 722 - protein, 22 aa, Artificial
  Peptide with targeting and/or antimicrobial activity
LVLRICTDLFTFIKWTIKQRKS

SEQ ID NO: 723 - protein, 30 aa, Artificial
  Peptide with targeting and/or antimicrobial activity
MSEEEEVSEKVYNYLRRNEFFEVRKEEFSA

SEQ ID NO: 724 - protein, 24 aa, Artificial
  Peptide with targeting and/or antimicrobial activity
VYSFLYVLVIVRKLLSMKKRIERL

SEQ ID NO: 725 - protein, 30 aa, Artificial
  Peptide with targeting and/or antimicrobial activity
MGIFKEEKIKFIDCKGEEVILKIKIKDIKK

SEQ ID NO: 726 - protein, 24 aa, Artificial
  Peptide with targeting and/or antimicrobial activity
GSTAHKSPIGSTNNQWGMKKTPTD

SEQ ID NO: 727 - protein, 19 aa, Artificial
  Peptide with targeting and/or antimicrobial activity
NKGKQMQDQTGKQPIVDNG

SEQ ID NO: 728 - protein, 19 aa, Artificial
  Peptide with targeting and/or antimicrobial activity
VVTLKDIVAVIEDQGYDVQ

SEQ ID NO: 729 - protein, 15 aa, Artificial
  Peptide with targeting and/or antimicrobial activity
ILSVELSTKTSASGS

SEQ ID NO: 730 - protein, 10 aa, Artificial
  Peptide with targeting and/or antimicrobial activity
GYTKDPGTGI

SEQ ID NO: 731 - protein, 24 aa, Artificial
  Peptide with targeting and/or antimicrobial activity
SGRGFALIVVLFILLIIVGAACIR

SEQ ID NO: 732 - protein, 13 aa, Artificial
  Peptide with targeting and/or antimicrobial activity
LALSIANLFKKKA

SEQ ID NO: 733 - protein, 14 aa, Artificial
  Peptide with targeting and/or antimicrobial activity
VSTFGKVVKVVDEK

SEQ ID NO: 734 - protein, 16 aa, Artificial
  Peptide with targeting and/or antimicrobial activity
EAKVQAKGEQIACNNY

SEQ ID NO: 735 - protein, 17 aa, Artificial
  Peptide with targeting and/or antimicrobial activity
WYLYKKQSNQNDRGIPK

SEQ ID NO: 736 - protein, 21 aa, Artificial
  Peptide with targeting and/or antimicrobial activity
VMQSLYVKPPLILVTKLAQQN

SEQ ID NO: 737 - protein, 16 aa, Artificial
  Peptide with targeting and/or antimicrobial activity
SFMPEIQKNTIPTQMK

SEQ ID NO: 738 - protein, 16 aa, Artificial
  Peptide with targeting and/or antimicrobial activity
SNGVGLGVGIGSGIRF

SEQ ID NO: 739 - protein, 24 aa, Artificial
  Peptide with targeting and/or antimicrobial activity
QRFYKLFYHIDLTNEQALKLFQVK

SEQ ID NO: 740 - protein, 21 aa, Artificial
  Peptide with targeting and/or antimicrobial activity
DKSTQDKDIKQAKLLAQELGL

SEQ ID NO: 741 - protein, 14 aa, Artificial
  Peptide with targeting and/or antimicrobial activity
VKPTMTASLISTVC

SEQ ID NO: 742 - protein, 21 aa, Artificial
  Peptide with targeting and/or antimicrobial activity
SFYSKYSRYIDNLAGAIFLFF

SEQ ID NO: 743 - protein, 14 aa, Artificial
  Peptide with targeting and/or antimicrobial activity
YLVYSGVLATAAAF

SEQ ID NO: 744 - protein, 39 aa, Artificial
  Peptide with targeting and/or antimicrobial activity
LGLTAGVAYAAQPTNQPTNQPTNQPTNQPTNQPTNQPRW

SEQ ID NO: 745 - protein, 15 aa, Artificial
  Peptide with targeting and/or antimicrobial activity
CGKLLEQKNFFLKTR

SEQ ID NO: 746 - protein, 20 aa, Artificial
  Peptide with targeting and/or antimicrobial activity
FELVDWLETNLGKILKSKSA

SEQ ID NO: 747 - protein, 30 aa, Artificial
  Peptide with targeting and/or antimicrobial activity
ASKQASKQASKQASKQASKQASRSLKNHLL

SEQ ID NO: 748 - protein, 24 aa, Artificial
  Peptide with targeting and/or antimicrobial activity
PDAPRTCYHKPILAALSRIVVTDR

SEQ ID NO: 749 - protein, 15 aa, Artificial
  Peptide with targeting and/or antimicrobial activity
VLLLFIFQPFQKQLL

SEQ ID NO: 750 - protein, 32 aa, Artificial
  Peptide with targeting and/or antimicrobial activity
GSVIKKRRKRMAKKKHRKLLKKTRIQRRRAGK

SEQ ID NO: 751 - protein, 17 aa, Artificial
  Peptide with targeting and/or antimicrobial activity
LVDVVVLIRRHLPKSCS

SEQ ID NO: 752 - protein, 13 aa, Artificial
  Peptide with targeting and/or antimicrobial activity
LSEMERRRLRKRA

SEQ ID NO: 753 - protein, 13 aa, Artificial
  Peptide with targeting and/or antimicrobial activity
LANDYYKKTKKSW

SEQ ID NO: 754 - protein, 27 aa, Artificial
  Peptide with targeting and/or antimicrobial activity
SIILTKKKRRKIPLSIDSQIYKYTFKQ

SEQ ID NO: 755 - protein, 19 aa, Artificial
  Peptide with targeting and/or antimicrobial activity
KSILILIKVIFIGQTTIIL

SEQ ID NO: 756 - protein, 23 aa, Artificial
  Peptide with targeting and/or antimicrobial activity
KKDNPSLNDQDKNAVLNLLALAK

SEQ ID NO: 757 - protein, 26 aa, Artificial
  Peptide with targeting and/or antimicrobial activity
NILFGIIGFVVAMTAAVIVTAISIAK

SEQ ID NO: 758 - protein, 17 aa, Artificial
  Peptide with targeting and/or antimicrobial activity
FGEKQMRSWWKVHWFHP

SEQ ID NO: 759 - protein, 16 aa, Artificial
  Peptide with targeting and/or antimicrobial activity
RESKLIAMADMIRRRI

SEQ ID NO: 760 - protein, 12 aa, Artificial
  Peptide with targeting and/or antimicrobial activity
PIIAPTIKTQIQ

SEQ ID NO: 761 - protein, 18 aa, Artificial
  Peptide with targeting and/or antimicrobial activity
WSRVPGHSDTGWKVWHRW

SEQ ID NO: 762 - protein, 26 aa, Artificial
  Peptide with targeting and/or antimicrobial activity
ARPIADLIHFNSTTVTASGDVYYGPG

SEQ ID NO: 763 - protein, 16 aa, Artificial
  Peptide with targeting and/or antimicrobial activity
TGIGPIARPIEHGLDS

SEQ ID NO: 764 - protein, 25 aa, Artificial
  Peptide with targeting and/or antimicrobial activity
STENGWQEFESYADVGVDPRRYVPL

SEQ ID NO: 765 - protein, 27 aa, Artificial
  Peptide with targeting and/or antimicrobial activity
QVKEKRREIELQFRDAEKKLEASVQAE

SEQ ID NO: 766 - protein, 24 aa, Artificial
  Peptide with targeting and/or antimicrobial activity
ELDKADAALGPAKNLAPLDVINRS

SEQ ID NO: 767 - protein, 26 aa, Artificial
  Peptide with targeting and/or antimicrobial activity
LTIVGNALQQKNQKLLLNQKKITSLG

SEQ ID NO: 768 - protein, 25 aa, Artificial
  Peptide with targeting and/or antimicrobial activity
AKNFLTRTAEEIGEQAVREGNINGP

SEQ ID NO: 769 - protein, 28 aa, Artificial
  Peptide with targeting and/or antimicrobial activity
EAYMRFLDREMEGLTAAYNVKLFTEAIS

SEQ ID NO: 770 - protein, 19 aa, Artificial
  Peptide with targeting and/or antimicrobial activity
SLQIRMNTLTAAKASIEAA

SEQ ID NO: 771 - protein, 22 aa, Artificial
  Peptide with targeting and/or antimicrobial activity
AANKAREQAAAEAKRKAEEQAR

SEQ ID NO: 772 - protein, 12 aa, Artificial
  Peptide with targeting and/or antimicrobial activity
ADAPPPLIVRYS

SEQ ID NO: 773 - protein, 25 aa, Artificial
  Peptide with targeting and/or antimicrobial activity
SRPGKPGGVSIDVSRDRQDILSNYP

SEQ ID NO: 774 - protein, 20 aa, Artificial
  Peptide with targeting and/or antimicrobial activity
FGNPFRGFTLAMEADFKKRK

SEQ ID NO: 775 - protein, 20 aa, Artificial
  Peptide with targeting and/or antimicrobial activity
TPEQWLERSTVVVTGLLNRK

SEQ ID NO: 776 - protein, 25 aa, Artificial
  Peptide with targeting and/or antimicrobial activity
RPELDNELDVVQNSASLDKLQASYN

SEQ ID NO: 777 - protein, 25 aa, Artificial
  Peptide with targeting and/or antimicrobial activity
TIILNDQINSLQERLNKLNAETDRR

SEQ ID NO: 778 - protein, 24 aa, Artificial
  Peptide with targeting and/or antimicrobial activity
EAQQVTQQLGADFNAITTPTATKV

SEQ ID NO: 779 - protein, 25 aa, Artificial
  Peptide with targeting and/or antimicrobial activity
QQRVKAVDASLSQVSTQVSGAVASA

SEQ ID NO: 780 - protein, 14 aa, Artificial
  Peptide with targeting and/or antimicrobial activity
TQAVQVKTAQAQQQ

SEQ ID NO: 781 - protein, 24 aa, Artificial
  Peptide with targeting and/or antimicrobial activity
KSKISEYTEKEFLEFVEDIYTNNK

SEQ ID NO: 782 - protein, 25 aa, Artificial
  Peptide with targeting and/or antimicrobial activity
KKFPTEESHIQAVLEFKKLTEHPSG

SEQ ID NO: 783 - protein, 13 aa, Artificial
  Peptide with targeting and/or antimicrobial activity
WRASKGLPGFKAG

SEQ ID NO: 784 - protein, 23 aa, Artificial
  Peptide with targeting and/or antimicrobial activity
EKKLIVKLIDSIGKSHEEIVGAG

SEQ ID NO: 785 - protein, 25 aa, Artificial
  Peptide with targeting and/or antimicrobial activity
LNFRAENKILEKIHISLIDTVEGSA

SEQ ID NO: 786 - protein, 25 aa, Artificial
  Peptide with targeting and/or antimicrobial activity
AYSGELPEPLVRKMSKEQVRSVMGK

SEQ ID NO: 787 - protein, 25 aa, Artificial
  Peptide with targeting and/or antimicrobial activity
PFETRESFRVPVIGILGGWDYFMHP

SEQ ID NO: 788 - protein, 28 aa, Artificial
  Peptide with targeting and/or antimicrobial activity
QKANLRIGFTYTSDSNVCNLTFALLGSK

SEQ ID NO: 789 - protein, 30 aa, Artificial
  Peptide with targeting and/or antimicrobial activity
MILVCAAVIWGRVLFILKFPIYFSIRLAFL

SEQ ID NO: 790 - protein, 33 aa, Artificial
  Peptide with targeting and/or antimicrobial activity
EILNNNQVIKELTMKYKTQFESNLGGWTARARR

SEQ ID NO: 791 - protein, 7 aa, Artificial
  Peptide with targeting and/or antimicrobial activity
WTARARR

SEQ ID NO: 792 - protein, 28 aa, Artificial
  Peptide with targeting and/or antimicrobial activity
KFQGEFTNIGQSYIVSASHMSTSLNTGK

SEQ ID NO: 793 - protein, 15 aa, Artificial
  Peptide with targeting and/or antimicrobial activity
SYIKNLSNQKFLIAF

SEQ ID NO: 794 - protein, 16 aa, Artificial
  Peptide with targeting and/or antimicrobial activity
DYNHLLNVVQDWVNTN

SEQ ID NO: 795 - protein, 12 aa, Artificial
  Peptide with targeting and/or antimicrobial activity
FFNQANYFFKEF

SEQ ID NO: 796 - protein, 35 aa, Artificial
  Peptide with targeting and/or antimicrobial activity
ASGKYQSYLLNVYVDSKKDRLDIFDKLKAKAKFVL

SEQ ID NO: 797 - protein, 12 aa, Artificial
  Peptide with targeting and/or antimicrobial activity
ESVEAIKAKAIK

SEQ ID NO: 798 - protein, 36 aa, Artificial
  Peptide with targeting and/or antimicrobial activity
APLRIDEIRNSNVIDEVLDCAPKKQEHFFVVPKIIE

SEQ ID NO: 799 - protein, 10 aa, Artificial
  Peptide with targeting and/or antimicrobial activity
YYQAKLFPLL

SEQ ID NO: 800 - protein, 18 aa, Artificial
  Peptide with targeting and/or antimicrobial activity
IMKNYKYFKLFIVKYALF

SEQ ID NO: 801 - protein, 26 aa, Artificial
  Peptide with targeting and/or antimicrobial activity
MEISTLKKEKLHVKDELSQYLANYKK

SEQ ID NO: 802 - protein, 6 aa, Artificial
  Peptide with targeting and/or antimicrobial activity
IVSAIV

SEQ ID NO: 803 - protein, 19 aa, Artificial
  Peptide with targeting and/or antimicrobial activity
LQNKIYELLYIKERSKLCS

SEQ ID NO: 804 - protein, 24 aa, Artificial
  Peptide with targeting and/or antimicrobial activity
SKMWDKILTILILILELIRELIKL

SEQ ID NO: 805 - protein, 19 aa, Artificial
  Peptide with targeting and/or antimicrobial activity
DEIKVSDEEIEKFIKENNL

SEQ ID NO: 806 - protein, 23 aa, Artificial
  Peptide with targeting and/or antimicrobial activity
MKFMLEVRNKAISAYKEITRTQI

SEQ ID NO: 807 - protein, 9 aa, Artificial
  Peptide with targeting and/or antimicrobial activity
LFEIFKPKH

SEQ ID NO: 808 - protein, 41 aa, Artificial
  Peptide with targeting and/or antimicrobial activity
TKKIELKRFVDAFVKKSYENYILERELKKLIKAINEELPTK

SEQ ID NO: 809 - protein, 9 aa, Artificial
  Peptide with targeting and/or antimicrobial activity
YRVTVKALE

SEQ ID NO: 810 - protein, 16 aa, Artificial
  Peptide with targeting and/or antimicrobial activity
LEKEKKEYIEKLFKTK

SEQ ID NO: 811 - protein, 30 aa, Artificial
  Peptide with targeting and/or antimicrobial activity
IDKLKKMNLQKLSYEVRISQDGKSIYARIK

SEQ ID NO: 812 - protein, 7 aa, Artificial
  Peptide with targeting and/or antimicrobial activity
LMEQVEV

SEQ ID NO: 813 - protein, 11 aa, Artificial
  Peptide with targeting and/or antimicrobial activity
HYRWNTQWWKY

SEQ ID NO: 814 - protein, 19 aa, Artificial
  Peptide with targeting and/or antimicrobial activity
YIESDPRKFDYIFGAIRDH

SEQ ID NO: 815 - protein, 23 aa, Artificial
  Peptide with targeting and/or antimicrobial activity
TEIKLDNNEYLVLNLDDILGILK

SEQ ID NO: 816 - protein, 19 aa, Artificial
  Peptide with targeting and/or antimicrobial activity
VFLKLKTSKIDLASIIFYP

SEQ ID NO: 817 - protein, 35 aa, Artificial
  Peptide with targeting and/or antimicrobial activity
GTTLKYGLERQLKIDIHPEITIINLNGGADEFAKL

SEQ ID NO: 818 - protein, 7 aa, Artificial
  Peptide with targeting and/or antimicrobial activity
ADEFAKL

SEQ ID NO: 819 - protein, 6 aa, Artificial
  Peptide with targeting and/or antimicrobial activity
GLDIYA

SEQ ID NO: 820 - protein, 25 aa, Artificial
  Peptide with targeting and/or antimicrobial activity
FLNRFIFYIFTVKTKSALIKNLFLD

SEQ ID NO: 821 - protein, 10 aa, Artificial
  Peptide with targeting and/or antimicrobial activity
IVFVVTKEKK

SEQ ID NO: 822 - protein, 8 aa, Artificial
  Peptide with targeting and/or antimicrobial activity
PMNAAEPE

SEQ ID NO: 823 - protein, 18 aa, Artificial
  Peptide with targeting and/or antimicrobial activity
WSRVPGHSDTGWKVWHRW

SEQ ID NO: 824 - protein, 7 aa, Artificial
  Peptide with targeting and/or antimicrobial activity
PPSSFLV

SEQ ID NO: 825 - protein, 19 aa, Artificial
  Peptide with targeting and/or antimicrobial activity
TREDVFSVRLINNIVNKQA

SEQ ID NO: 826 - protein, 21 aa, Artificial
  Peptide with targeting and/or antimicrobial activity
VLFAVYLGALDWLFSWLTQKM

SEQ ID NO: 827 - protein, 23 aa, Artificial
  Peptide with targeting and/or antimicrobial activity
SDSTNNARTRKKARDVTTKDIDK

SEQ ID NO: 828 - protein, 12 aa, Artificial
  Peptide with targeting and/or antimicrobial activity
KYDFDDFEPEEA

SEQ ID NO: 829 - protein, 13 aa, Artificial
  Peptide with targeting and/or antimicrobial activity
INDLLSYFTLHEK

SEQ ID NO: 830 - protein, 12 aa, Artificial
  Peptide with targeting and/or antimicrobial activity
GLAAIATVFALY

SEQ ID NO: 831 - protein, 9 aa, Artificial
  Peptide with targeting and/or antimicrobial activity
IPATPIIHS

SEQ ID NO: 832 - protein, 18 aa, Artificial
  Peptide with targeting and/or antimicrobial activity
LIIYFSKTGNTARATRQI

SEQ ID NO: 833 - protein, 24 aa, Artificial
  Peptide with targeting and/or antimicrobial activity
TTIQGVASLEKHGFRYTIIYPTRI

SEQ ID NO: 834 - protein, 30 aa, Artificial
  Peptide with targeting and/or antimicrobial activity
MPKARPVNHNKKKSKITIKSNFTLFYMFNP

SEQ ID NO: 835 - protein, 30 aa, Artificial
  Peptide with targeting and/or antimicrobial activity
MNAHGHSLIFQKMIVHAFAFFSKQKNYLYF

SEQ ID NO: 836 - protein, 5 aa, Artificial
  Peptide with targeting and/or antimicrobial activity
LVRLA

SEQ ID NO: 837 - protein, 26 aa, Artificial
  Peptide with targeting and/or antimicrobial activity
SRIKQDARSVRKYDRIGIFFYSFKSA

SEQ ID NO: 838 - protein, 6 aa, Artificial
  Peptide with targeting and/or antimicrobial activity
TFILPK

SEQ ID NO: 839 - protein, 17 aa, Artificial
  Peptide with targeting and/or antimicrobial activity
QATQIKSWIDRLLVSED

SEQ ID NO: 840 - protein, 8 aa, Artificial
  Peptide with targeting and/or antimicrobial activity
MGDINRNF

SEQ ID NO: 841 - protein, 20 aa, Artificial
  Peptide with targeting and/or antimicrobial activity
SWKCHHLAIGGSWKCHHLAI

SEQ ID NO: 842 - protein, 27 aa, Artificial
  Peptide with targeting and/or antimicrobial activity
FTTPMIGIPAGLLGGSYYLKRREEKGK

SEQ ID NO: 843 - protein, 5 aa, Artificial
  Peptide with targeting and/or antimicrobial activity
VRCRL

SEQ ID NO: 844 - protein, 14 aa, Artificial
  Peptide with targeting and/or antimicrobial activity
TSGLIIGENGLNGL

SEQ ID NO: 845 - protein, 7 aa, Artificial
  Peptide with targeting and/or antimicrobial activity
SNSVQQG

SEQ ID NO: 846 - protein, 10 aa, Artificial
  Peptide with targeting and/or antimicrobial activity
APASPGRRPG

SEQ ID NO: 847 - protein, 14 aa, Artificial
  Peptide with targeting and/or antimicrobial activity
GTFLGQKCAAATAS

SEQ ID NO: 848 - protein, 9 aa, Artificial
  Peptide with targeting and/or antimicrobial activity
ARRYPAAGS

SEQ ID NO: 849 - protein, 23 aa, Artificial
  Peptide with targeting and/or antimicrobial activity
CPRYPFVDVGPAGPWRARWRVGS

SEQ ID NO: 850 - protein, 24 aa, Artificial
  Peptide with targeting and/or antimicrobial activity
IRSDQPGRQSRSSPRWPTGAGRHR

SEQ ID NO: 851 - protein, 11 aa, Artificial
  Peptide with targeting and/or antimicrobial activity
PRWPTGAGRHR

SEQ ID NO: 852 - protein, 18 aa, Artificial
  Peptide with targeting and/or antimicrobial activity
FLAPARPDLQAQRQALAQ

SEQ ID NO: 853 - protein, 16 aa, Artificial
  Peptide with targeting and/or antimicrobial activity
QSVHPLPAETPVADVI

SEQ ID NO: 854 - protein, 9 aa, Artificial
  Peptide with targeting and/or antimicrobial activity
LSGRLAGRR

SEQ ID NO: 855 - protein, 17 aa, Artificial
  Peptide with targeting and/or antimicrobial activity
DAPCFDDQFGDLKCQMC

SEQ ID NO: 856 - protein, 14 aa, Artificial
  Peptide with targeting and/or antimicrobial activity
RGMFVPFHDVDCVQ

SEQ ID NO: 857 - protein, 25 aa, Artificial
  Peptide with targeting and/or antimicrobial activity
YVANYTITQFGRDFDDRLAVAIHFA

SEQ ID NO: 858 - protein, 21 aa, Artificial
  Peptide with targeting and/or antimicrobial activity
PTTPPPTTPPEIPTGGTVIST

SEQ ID NO: 859 - protein, 5 aa, Artificial
  Peptide with targeting and/or antimicrobial activity
TVIST

SEQ ID NO: 860 - protein, 16 aa, Artificial
  Peptide with targeting and/or antimicrobial activity
TDPQATAAPRRRTSPR

SEQ ID NO: 861 - protein, 23 aa, Artificial
  Peptide with targeting and/or antimicrobial activity
PDEDIRRRAILPPAGPCRPMSPE

SEQ ID NO: 862 - protein, 21 aa, Artificial
  Peptide with targeting and/or antimicrobial activity
GKQSRAHGPVASRREFRRKSG

SEQ ID NO: 863 - protein, 8 aa, Artificial
  Peptide with targeting and/or antimicrobial activity
ATLIPRKA

SEQ ID NO: 864 - protein, 14 aa, Artificial
  Peptide with targeting and/or antimicrobial activity
DQLCVEYPARVSTG

SEQ ID NO: 865 - protein, 15 aa, Artificial
  Peptide with targeting and/or antimicrobial activity
VLRVATAVGEVPTGL

SEQ ID NO: 866 - protein, 8 aa, Artificial
  Peptide with targeting and/or antimicrobial activity
PNRRSRPR

SEQ ID NO: 867 - protein, 24 aa, Artificial
  Peptide with targeting and/or antimicrobial activity
PAHQRLRIDQRLVADRDMVQDYES

SEQ ID NO: 868 - protein, 24 aa, Artificial
  Peptide with targeting and/or antimicrobial activity
TNAESMALAFRGRVHMSVNIAGLT

SEQ ID NO: 869 - protein, 24 aa, Artificial
  Peptide with targeting and/or antimicrobial activity
RADRIESYPADGDRVITLWRNPYR

SEQ ID NO: 870 - protein, 11 aa, Artificial
  Peptide with targeting and/or antimicrobial activity
TVIVAPMHSGV

SEQ ID NO: 871 - protein, 9 aa, Artificial
  Peptide with targeting and/or antimicrobial activity
TVSAFRTVH

SEQ ID NO: 872 - protein, 6 aa, Artificial
  Peptide with targeting and/or antimicrobial activity
VRRLRM

SEQ ID NO: 873 - protein, 12 aa, Artificial
  Peptide with targeting and/or antimicrobial activity
DGCDSEPALTYR

SEQ ID NO: 874 - protein, 24 aa, Artificial
  Peptide with targeting and/or antimicrobial activity
EIIPISPTRRCEMHTMSSAEYRGL

SEQ ID NO: 875 - protein, 6 aa, Artificial
  Peptide with targeting and/or antimicrobial activity
AEYRGL

SEQ ID NO: 876 - protein, 8 aa, Artificial
  Peptide with targeting and/or antimicrobial activity
TCRGAGMH

SEQ ID NO: 877 - protein, 19 aa, Artificial
  Peptide with targeting and/or antimicrobial activity
RDRRWTRRDMYDWLESARV

SEQ ID NO: 878 - protein, 8 aa, Artificial
  Peptide with targeting and/or antimicrobial activity
CRARFIRR

SEQ ID NO: 879 - protein, 9 aa, Artificial
  Peptide with targeting and/or antimicrobial activity
ADPHPTTGI

SEQ ID NO: 880 - protein, 23 aa, Artificial
  Peptide with targeting and/or antimicrobial activity
TALTTVGVSGARLITYCVGVEDI

SEQ ID NO: 881 - protein, 12 aa, Artificial
  Peptide with targeting and/or antimicrobial activity
RRGKSEQGLSRR

SEQ ID NO: 882 - protein, 5 aa, Artificial
  Peptide with targeting and/or antimicrobial activity
LWPVA

SEQ ID NO: 883 - protein, 17 aa, Artificial
  Peptide with targeting and/or antimicrobial activity
RKLSLASGFALWRRSLV

SEQ ID NO: 884 - protein, 8 aa, Artificial
  Peptide with targeting and/or antimicrobial activity
PTLWLACL

SEQ ID NO: 885 - protein, 22 aa, Artificial
  Peptide with targeting and/or antimicrobial activity
LAVLMGYIGYRGWSGKRHINRQ

SEQ ID NO: 886 - protein, 20 aa, Artificial
  Peptide with targeting and/or antimicrobial activity
AKRVLSLAVAPHRRQPVQGT

SEQ ID NO: 887 - protein, 10 aa, Artificial
  Peptide with targeting and/or antimicrobial activity
ARNHAVIPAG

SEQ ID NO: 888 - protein, 5 aa, Artificial
  Peptide with targeting and/or antimicrobial activity
SAPSG

SEQ ID NO: 889 - protein, 30 aa, Artificial
  Peptide with targeting and/or antimicrobial activity
MIPLAGDPVSSHRTVEFGVLGTYLVSGGSL

SEQ ID NO: 890 - protein, 19 aa, Artificial
  Peptide with targeting and/or antimicrobial activity
HRTVEFGVLGTYLVSGGSL

SEQ ID NO: 891 - protein, 21 aa, Artificial
  Peptide with targeting and/or antimicrobial activity
GVAREDPLEPDPLAPIIDDSR

SEQ ID NO: 892 - protein, 5 aa, Artificial
  Peptide with targeting and/or antimicrobial activity
PDPAR

SEQ ID NO: 893 - protein, 15 aa, Artificial
  Peptide with targeting and/or antimicrobial activity
DLIRPLYSMSAPSVA

SEQ ID NO: 894 - protein, 19 aa, Artificial
  Peptide with targeting and/or antimicrobial activity
ALSVMLGNIPLVVPNANQL

SEQ ID NO: 895 - protein, 14 aa, Artificial
  Peptide with targeting and/or antimicrobial activity
IRSGISAAYARPLR

SEQ ID NO: 896 - protein, 7 aa, Artificial
  Peptide with targeting and/or antimicrobial activity
RADARAK

SEQ ID NO: 897 - protein, 15 aa, Artificial
  Peptide with targeting and/or antimicrobial activity
SSGRAGVKCRRPTGR

SEQ ID NO: 898 - protein, 13 aa, Artificial
  Peptide with targeting and/or antimicrobial activity
GRAGVKCRRPTGR

SEQ ID NO: 899 - protein, 8 aa, Artificial
  Peptide with targeting and/or antimicrobial activity
LNWPFTGR

SEQ ID NO: 900 - protein, 9 aa, Artificial
  Peptide with targeting and/or antimicrobial activity
PRGAQSGHG

SEQ ID NO: 901 - protein, 9 aa, Artificial
  Peptide with targeting and/or antimicrobial activity
LSGRLAGRR

SEQ ID NO: 902 - protein, 30 aa, Artificial
  Peptide with targeting and/or antimicrobial activity
MTTVDNIVGLVIAVALMAFLFAALLFPEKF

SEQ ID NO: 903 - protein, 8 aa, Artificial
  Peptide with targeting and/or antimicrobial activity
APAARAAL

SEQ ID NO: 904 - protein, 9 aa, Artificial
  Peptide with targeting and/or antimicrobial activity
GEEEGTVAD

SEQ ID NO: 905 - protein, 20 aa, Artificial
  Peptide with targeting and/or antimicrobial activity
LGYGAWIGCGLGLNGFHRID

SEQ ID NO: 906 - protein, 19 aa, Artificial
  Peptide with targeting and/or antimicrobial activity
IDPESIVTTNNKQDNVDEQ

SEQ ID NO: 907 - protein, 8 aa, Artificial
  Peptide with targeting and/or antimicrobial activity
NKKHSPMD

SEQ ID NO: 908 - protein, 13 aa, Artificial
  Peptide with targeting and/or antimicrobial activity
KTAGPTGTIYKTN

SEQ ID NO: 909 - protein, 19 aa, Artificial
  Peptide with targeting and/or antimicrobial activity
QIYRHVHKVQAKSANLRLY

SEQ ID NO: 910 - protein, 13 aa, Artificial
  Peptide with targeting and/or antimicrobial activity
FVVTQRMLRMYKK

SEQ ID NO: 911 - protein, 21 aa, Artificial
  Peptide with targeting and/or antimicrobial activity
HGENHHHKSDEKDNDSSEKKD

SEQ ID NO: 912 - protein, 23 aa, Artificial
  Peptide with targeting and/or antimicrobial activity
PQSEVTFENIYAPKANGGGLYGI

SEQ ID NO: 913 - protein, 6 aa, Artificial
  Peptide with targeting and/or antimicrobial activity
SLDMGK

SEQ ID NO: 914 - protein, 14 aa, Artificial
  Peptide with targeting and/or antimicrobial activity
CYRFLTPKRPTRIS

SEQ ID NO: 915 - protein, 19 aa, Artificial
  Peptide with targeting and/or antimicrobial activity
AYARCRHDYPFTLGQMQTH

SEQ ID NO: 916 - protein, 21 aa, Artificial
  Peptide with targeting and/or antimicrobial activity
AIGQEQDRREYYYYSGYPYYY

SEQ ID NO: 917 - protein, 22 aa, Artificial
  Peptide with targeting and/or antimicrobial activity
RHKLIRLPLSESVFCFLNNPKI

SEQ ID NO: 918 - protein, 20 aa, Artificial
  Peptide with targeting and/or antimicrobial activity
DRPSQTTHHTLSSSRITGPS

SEQ ID NO: 919 - protein, 18 aa, Artificial
  Peptide with targeting and/or antimicrobial activity
VISRQMGSEAVLELFIIM

SEQ ID NO: 920 - protein, 10 aa, Artificial
  Peptide with targeting and/or antimicrobial activity
YDPLFPNDKN

SEQ ID NO: 921 - protein, 19 aa, Artificial
  Peptide with targeting and/or antimicrobial activity
KSSGSSASASSTAGGSSSK

SEQ ID NO: 922 - protein, 17 aa, Artificial
  Peptide with targeting and/or antimicrobial activity
KSGATSAASGAKSGASS

SEQ ID NO: 923 - protein, 20 aa, Artificial
  Peptide with targeting and/or antimicrobial activity
AKREDTVAAQIGANILNLIQ

SEQ ID NO: 924 - protein, 25 aa, Artificial
  Peptide with targeting and/or antimicrobial activity
LGVGTFVGKVLIKNQQKQKSKKKAQ

SEQ ID NO: 925 - protein, 38 aa, Artificial
  Peptide with targeting and/or antimicrobial activity
ANSQNSLFSNRSSFKSIFDKKSNITTNATTPNSNIIIN

SEQ ID NO: 926 - protein, 11 aa, Artificial
  Peptide with targeting and/or antimicrobial activity
FLGNSQYFTRK

SEQ ID NO: 927 - protein, 40 aa, Artificial
  Peptide with targeting and/or antimicrobial activity
FQGFFDVAVNKWWEEHNKAKLWKNVKGKFLEGEGEEEDDE

SEQ ID NO: 928 - protein, 33 aa, Artificial
  Peptide with targeting and/or antimicrobial activity
GVNKWWEEHNKAKLWKNVKGKFLEGEGEEEDDE

SEQ ID NO: 929 - protein, 10 aa, Artificial
  Peptide with targeting and/or antimicrobial activity
AESSPAKTTA

SEQ ID NO: 930 - protein, 10 aa, Artificial
  Peptide with targeting and/or antimicrobial activity
AESSPAQETT

SEQ ID NO: 931 - protein, 30 aa, Artificial
  Peptide with targeting and/or antimicrobial activity
LHVIRPRPELSELKFPITKILKVNKQGLKK

SEQ ID NO: 932 - protein, 7 aa, Artificial
  Peptide with targeting and/or antimicrobial activity
DALLRLA

SEQ ID NO: 933 - protein, 11 aa, Artificial
  Peptide with targeting and/or antimicrobial activity
PQAISSVQQNA

SEQ ID NO: 934 - protein, 11 aa, Artificial
  Peptide with targeting and/or antimicrobial activity
PEIIKIVSGLL

SEQ ID NO: 935 - protein, 21 aa, Artificial
  Peptide with targeting and/or antimicrobial activity
DHITLDDYEIHDGFNFELYYG

SEQ ID NO: 936 - protein, 32 aa, Artificial
  Peptide with targeting and/or antimicrobial activity
SKFELVNYASGCSCGADCKCASETECKCASKK

SEQ ID NO: 937 - protein, 19 aa, Artificial
  Peptide with targeting and/or antimicrobial activity
PAPAPSAPAPAPEQPEQPA

SEQ ID NO: 938 - protein, 43 aa, Artificial
  Peptide with targeting and/or antimicrobial activity
GIWMARNYFHRSSIRKVYVESDKEYERVHPMQKIQYEGNYKSQ

SEQ ID NO: 939 - protein, 9 aa, Artificial
  Peptide with targeting and/or antimicrobial activity
GYFEPGKRD

SEQ ID NO: 940 - protein, 32 aa, Artificial
  Peptide with targeting and/or antimicrobial activity
YLYWEVEHKPIIAKRDAYYAQLRKQKEIEEGA

SEQ ID NO: 941 - protein, 17 aa, Artificial
  Peptide with targeting and/or antimicrobial activity
DAYYAQLRKQKEIEEGA

SEQ ID NO: 942 - protein, 15 aa, Artificial
  Peptide with targeting and/or antimicrobial activity
DGKQGEPVALKPTDN

SEQ ID NO: 943 - protein, 12 aa, Artificial
  Peptide with targeting and/or antimicrobial activity
GFRGGKRGGARG

SEQ ID NO: 944 - protein, 28 aa, Artificial
  Peptide with targeting and/or antimicrobial activity
GVGIGFIMMGVVGYAVKLVHIPIRYLIV

SEQ ID NO: 945 - protein, 6 aa, Artificial
  Peptide with targeting and/or antimicrobial activity
TKESSS

SEQ ID NO: 946 - protein, 6 aa, Artificial
  Peptide with targeting and/or antimicrobial activity
TLKESK

SEQ ID NO: 947 - protein, 29 aa, Artificial
  Peptide with targeting and/or antimicrobial activity
VSILLYLSATIILPNVLRLLVARAIIVRV

SEQ ID NO: 948 - protein, 20 aa, Artificial
  Peptide with targeting and/or antimicrobial activity
PGADGKLAEASAAIARLVRS

SEQ ID NO: 949 - protein, 10 aa, Artificial
  Peptide with targeting and/or antimicrobial activity
MNLILTAHGT

SEQ ID NO: 950 - protein, 42 aa, Artificial
  Peptide with targeting and/or antimicrobial activity
IYGDFFNFYLCDISLKVNGLQPGGPVRTVKLFGQPTGRCTPQ

SEQ ID NO: 951 - protein, 40 aa, Artificial
  Peptide with targeting and/or antimicrobial activity
AVYDALVALAAAEHRAELATRDARAKDTYEKIGVHVVVAA

SEQ ID NO: 952 - protein, 15 aa, Artificial
  Peptide with targeting and/or antimicrobial activity
PLVVVNHRRAERSRG

SEQ ID NO: 953 - protein, 29 aa, Artificial
  Peptide with targeting and/or antimicrobial activity
TGPRRGIDLTSNRALSEVLDEGLELNSRK

SEQ ID NO: 954 - protein, 37 aa, Artificial
  Peptide with targeting and/or antimicrobial activity
FTSEVRGVFTYRVNKAGLITNMRGYWNLDMMTFGNQE

SEQ ID NO: 955 - protein, 32 aa, Artificial
  Peptide with targeting and/or antimicrobial activity
MAMTTVDNIVGLVIAVALMAFLFAALLFPEKF

SEQ ID NO: 956 - protein, 22 aa, Artificial
  Peptide with targeting and/or antimicrobial activity
MRPQHSPAGKAFVVKKITHEQS

SEQ ID NO: 957 - protein, 14 aa, Artificial
  Peptide with targeting and/or antimicrobial activity
LSERERRRLKRGII

SEQ ID NO: 958 - protein, 34 aa, Artificial
  Peptide with targeting and/or antimicrobial activity
MTERQRRALLKQHPEVVSWSDYLEKRKRRTGTAG

SEQ ID NO: 959 - protein, 28 aa, Artificial
  Peptide with targeting and/or antimicrobial activity
GLITVFAGTARILQLRRAAKKTHAAALR

SEQ ID NO: 960 - protein, 9 aa, Artificial
  Peptide with targeting and/or antimicrobial activity
PRGAQSGHG

SEQ ID NO: 961 - protein, 13 aa, Artificial
  Peptide with targeting and/or antimicrobial activity
PAGPDHLDQRDHR

SEQ ID NO: 962 - protein, 16 aa, Artificial
  Peptide with targeting and/or antimicrobial activity
IFLTTQNTDYSEHNAA

SEQ ID NO: 963 - protein, 10 aa, Artificial
  Peptide with targeting and/or antimicrobial activity
ALHASGIQAI

SEQ ID NO: 964 - protein, 21 aa, Artificial
  Peptide with targeting and/or antimicrobial activity
  MOD_RES (4)..(4): Aib
YTQXNNASAYAMLLTNKDTVP

SEQ ID NO: 965 - protein, 9 aa, Artificial
  Peptide with targeting and/or antimicrobial activity
NLYFENQGN

SEQ ID NO: 966 - protein, 20 aa, Artificial
  Peptide with targeting and/or antimicrobial activity
ALHKSGIQVIADWVPDQIYN

SEQ ID NO: 967 - protein, 20 aa, Artificial
  Peptide with targeting and/or antimicrobial activity
YTQSNIPTAYALMLSNKDSI

SEQ ID NO: 968 - protein, 10 aa, Artificial
  Peptide with targeting and/or antimicrobial activity
WYYFDNNGYM

SEQ ID NO: 969 - protein, 20 aa, Artificial
  Peptide with targeting and/or antimicrobial activity
ALHSKGIKVMADWVPDQMYA

SEQ ID NO: 970 - protein, 21 aa, Artificial
  Peptide with targeting and/or antimicrobial activity
YTHYNTALSYALLLTNKSSVP

SEQ ID NO: 971 - protein, 10 aa, Artificial
  Peptide with targeting and/or antimicrobial activity
WYYFDNNGYM

SEQ ID NO: 972 - protein, 22 aa, Artificial
  Peptide with targeting and/or antimicrobial activity
FCSVDHDVITIAADHVKQGAEA

SEQ ID NO: 973 - protein, 27 aa, Artificial
  Peptide with targeting and/or antimicrobial activity
AQPRRTWLVNFGEVPSPGLTNDGMPDH

SEQ ID NO: 974 - protein, 21 aa, Artificial
  Peptide with targeting and/or antimicrobial activity
HPMPITVRSRKPGPLTAPSEH

SEQ ID NO: 975 - protein, 26 aa, Artificial
  Peptide with targeting and/or antimicrobial activity
FREGMGWPLSNEGSPTAPLPKHRNQV

SEQ ID NO: 976 - protein, 13 aa, Artificial
  Peptide with targeting and/or antimicrobial activity
QGLARPVLRRIPL

SEQ ID NO: 977 - protein, 7 aa, Artificial
  Peptide with targeting and/or antimicrobial activity
SRFRNGV

SEQ ID NO: 978 - protein, 25 aa, Artificial
  Peptide with targeting and/or antimicrobial activity
YNLSIYIYFLHTITIAGLITLPFII

SEQ ID NO: 979 - protein, 27 aa, Artificial
  Peptide with targeting and/or antimicrobial activity
YFWWYWVQDCIPYKNNEVWLELSNNMK

SEQ ID NO: 980 - protein, 36 aa, Artificial
  Peptide with targeting and/or antimicrobial activity
FETGFGDGYYMSLWGLNEKDEVCKVVIPFINPELID

SEQ ID NO: 981 - protein, 33 aa, Artificial
  Peptide with targeting and/or antimicrobial activity
TLNYKKMFFSVIFLLGLNYLICNSPLFFKQIEF

SEQ ID NO: 982 - protein, 24 aa, Artificial
  Peptide with targeting and/or antimicrobial activity
PLARATEVVATLFIICSLLLYLTR

SEQ ID NO: 983 - protein, 7 aa, Artificial
  Peptide with targeting and/or antimicrobial activity
SHFRKGD

SEQ ID NO: 984 - protein, 24 aa, Artificial
  Peptide with targeting and/or antimicrobial activity
DEEALEMGANLYAQFAIDFLNSKK

SEQ ID NO: 985 - protein, 40 aa, Artificial
  Peptide with targeting and/or antimicrobial activity
DEERYSDSYFLKEKVFYLILALFLILFHQKYLYFLEIITI

SEQ ID NO: 986 - protein, 7 aa, Artificial
  Peptide with targeting and/or antimicrobial activity
LNLFASI

SEQ ID NO: 987 - protein, 28 aa, Artificial
  Peptide with targeting and/or antimicrobial activity
NALMLREMQLAKNIKVEVTDVLSNKKYC

SEQ ID NO: 988 - protein, 7 aa, Artificial
  Peptide with targeting and/or antimicrobial activity
QVIVKIL

SEQ ID NO: 989 - protein, 41 aa, Artificial
  Peptide with targeting and/or antimicrobial activity
KKMFSLIRKVNWIFFILFIVLDLTNVFPLIRTILFAILSRQ

SEQ ID NO: 990 - protein, 26 aa, Artificial
  Peptide with targeting and/or antimicrobial activity
KALVISVFAIVFSIIFVKFFYWRDKK

SEQ ID NO: 991 - protein, 7 aa, Artificial
  Peptide with targeting and/or antimicrobial activity
INIPGLF

SEQ ID NO: 992 - protein, 24 aa, Artificial
  Peptide with targeting and/or antimicrobial activity
FFSVIFLFGLNYLICNSPLFNILR

SEQ ID NO: 993 - protein, 25 aa, Artificial
  Peptide with targeting and/or antimicrobial activity
KKFKIFVIINWFYHKYIILNFEENF

SEQ ID NO: 994 - protein, 30 aa, Artificial
  Peptide with targeting and/or antimicrobial activity
ELFFTILSDCNELFLLHLLQQPLFYIKKGK

SEQ ID NO: 995 - protein, 17 aa, Artificial
  Peptide with targeting and/or antimicrobial activity
DIANNILNSVSERLIIA

SEQ ID NO: 996 - protein, 31 aa, Artificial
  Peptide with targeting and/or antimicrobial activity
ASNTPRFVRLTLFNFYSKIWNVTHLFLFNNL

SEQ ID NO: 997 - protein, 7 aa, Artificial
  Peptide with targeting and/or antimicrobial activity
EKLGTMV

SEQ ID NO: 998 - protein, 35 aa, Artificial
  Peptide with targeting and/or antimicrobial activity
LLALNMNEDTYYFELFFIFDNQNKKWLIFDLKERG

SEQ ID NO: 999 - protein, 36 aa, Artificial
  Peptide with targeting and/or antimicrobial activity
PETKGKVSAFVFGIVVANVIAVVYILYMLREIGIIQ

SEQ ID NO: 1000 - protein, 33 aa, Artificial
  Peptide with targeting and/or antimicrobial activity
ASLSTMTFKVMELKELIILLCGLTMLMIQTEFV

SEQ ID NO: 1001 - protein, 27 aa, Artificial
  Peptide with targeting and/or antimicrobial activity
QWIVAKREIRMHIYCHISVIHVIIFFG

SEQ ID NO: 1002 - protein, 29 aa, Artificial
  Peptide with targeting and/or antimicrobial activity
NELMKYPATLTATATTPGIKYSHLCSVCL

SEQ ID NO: 1003 - protein, 36 aa, Artificial
  Peptide with targeting and/or antimicrobial activity
KNTHAYLRVLRLSSLILSYQASVYPLFAYLCQQKDY

SEQ ID NO: 1004 - protein, 22 aa, Artificial
  Peptide with targeting and/or antimicrobial activity
LILSYQASVYPLFAYLCQQKDY

SEQ ID NO: 1005 - protein, 25 aa, Artificial
  Peptide with targeting and/or antimicrobial activity
QRMYWFKRGFETGDFSAGDTFAELK

SEQ ID NO: 1006 - protein, 27 aa, Artificial
  Peptide with targeting and/or antimicrobial activity
LLASHPERLSLGVFFVYRVLHLLLENT

SEQ ID NO: 1007 - protein, 28 aa, Artificial
  Peptide with targeting and/or antimicrobial activity
DFPPLSFFRRRFHAYTAPIDNFFGANPF

SEQ ID NO: 1008 - protein, 10 aa, Artificial
  Peptide with targeting and/or antimicrobial activity
VVFGGGDRLV

SEQ ID NO: 1009 - protein, 7 aa, Artificial
  Peptide with targeting and/or antimicrobial activity
YGKESDP

SEQ ID NO: 1010 - protein, 17 aa, Artificial
  Peptide with targeting and/or antimicrobial activity
AASGFTYCASNGVWHPY

SEQ ID NO: 1011 - protein, 40 aa, Artificial
  Peptide with targeting and/or antimicrobial activity
TVEELDKAFTWGAAAALAIGVIAINVGLAAGYCYNNNDVF

SEQ ID NO: 1012 - protein, 33 aa, Artificial
  Peptide with targeting and/or antimicrobial activity
KMRAGQVVFIYKLILVLLFYVLQKLFDLKKGCF

SEQ ID NO: 1013 - protein, 41 aa, Artificial
  Peptide with targeting and/or antimicrobial activity
NTNDLLQAFELMGLGMAGVFIVLGILYIVAELLIKIFPVNN

SEQ ID NO: 1014 - protein, 11 aa, Artificial
  Peptide with targeting and/or antimicrobial activity
AEIQPHCLSVL

SEQ ID NO: 1015 - protein, 13 aa, Artificial
  Peptide with targeting and/or antimicrobial activity
FFPSYYSIIITYF

SEQ ID NO: 1016 - protein, 31 aa, Artificial
  Peptide with targeting and/or antimicrobial activity
KNMLKRRMKQKRLFDEEDRLRVLSKYTKSYY

SEQ ID NO: 1017 - protein, 30 aa, Artificial
  Peptide with targeting and/or antimicrobial activity
KKEKLLTAIRLQHRAEIRGYFTIFFLFFRI

SEQ ID NO: 1018 - protein, 32 aa, Artificial
  Peptide with targeting and/or antimicrobial activity
FTIIELKKQKIKHGENNKKTAHPLNEPFCARA

SEQ ID NO: 1019 - protein, 30 aa, Artificial
  Peptide with targeting and/or antimicrobial activity
GNVHPESDFHNLIQFIKTFLYFTIFFKYFL

SEQ ID NO: 1020 - protein, 29 aa, Artificial
  Peptide with targeting and/or antimicrobial activity
HPFLTGTGCPLFLIFRLFFVKAYFSFTVF

SEQ ID NO: 1021 - protein, 32 aa, Artificial
  Peptide with targeting and/or antimicrobial activity
ALALLKQDLLNFEGRGRIITSTYLQFNEGCVP

SEQ ID NO: 1022 - protein, 31 aa, Artificial
  Peptide with targeting and/or antimicrobial activity
VLLNIFRTLLEFFSPSNAPGAEDVPLPDTQA

SEQ ID NO: 1023 - protein, 34 aa, Artificial
  Peptide with targeting and/or antimicrobial activity
VVAGVVLLTALAVGSKRKEKKQIKEIQRLLAATR

SEQ ID NO: 1024 - protein, 12 aa, Artificial
  Peptide with targeting and/or antimicrobial activity
IENLERGARRPP

SEQ ID NO: 1025 - protein, 10 aa, Artificial
  Peptide with targeting and/or antimicrobial activity
GMPQIPRLRI

SEQ ID NO: 1026 - protein, 26 aa, Artificial
  Peptide with targeting and/or antimicrobial activity
MAEDERRALKRRTNRGRTRTRKRITV

SEQ ID NO: 1027 - protein, 24 aa, Artificial
  Peptide with targeting and/or antimicrobial activity
TELKYNGEEYLLLTQRDILAVIEK

SEQ ID NO: 1028 - protein, 32 aa, Artificial
  Peptide with targeting and/or antimicrobial activity
TSDTQSQSPWLFDNADIVNIYPVQLMHSSDND

SEQ ID NO: 1029 - protein, 17 aa, Artificial
  Peptide with targeting and/or antimicrobial activity
GLGRVIGRLIKQIIWRR

SEQ ID NO: 1030 - protein, 19 aa, Artificial
  Peptide with targeting and/or antimicrobial activity
VYRKRKSILKIYAKLKGWH

SEQ ID NO: 1031 - protein, 20 aa, Artificial
  Peptide with targeting and/or antimicrobial activity
NYRLVNAIFSKIFKKKFIKF

SEQ ID NO: 1032 - protein, 11 aa, Artificial
  Peptide with targeting and/or antimicrobial activity
KILKFLFKKVF

SEQ ID NO: 1033 - protein, 11 aa, Artificial
  Peptide with targeting and/or antimicrobial activity
FIRKFLKKWLL

SEQ ID NO: 1034 - protein, 11 aa, Artificial
  Peptide with targeting and/or antimicrobial activity
KLFKFLRKHLL

SEQ ID NO: 1035 - protein, 11 aa, Artificial
  Peptide with targeting and/or antimicrobial activity
KILKFLFKQVF

SEQ ID NO: 1036 - protein, 11 aa, Artificial
  Peptide with targeting and/or antimicrobial activity
KILKKLFKFVF

SEQ ID NO: 1037 - protein, 11 aa, Artificial
  Peptide with targeting and/or antimicrobial activity
GILKKLFTKVF

SEQ ID NO: 1038 - protein, 9 aa, Artificial
  Peptide with targeting and/or antimicrobial activity
LRKFLHKLF

SEQ ID NO: 1039 - protein, 9 aa, Artificial
  Peptide with targeting and/or antimicrobial activity
LRKNLRWLF

SEQ ID NO: 1040 - protein, 11 aa, Artificial
  Peptide with targeting and/or antimicrobial activity
FIRKFLQKLHL

SEQ ID NO: 1041 - protein, 11 aa, Artificial
  Peptide with targeting and/or antimicrobial activity
FTRKFLKFLHL

SEQ ID NO: 1042 - protein, 12 aa, Artificial
  Peptide with targeting and/or antimicrobial activity
KKFKKFKVLKIL

SEQ ID NO: 1043 - protein, 12 aa, Artificial
  Peptide with targeting and/or antimicrobial activity
LLKLLKLKKLKF

SEQ ID NO: 1044 - protein, 14 aa, Artificial
  Peptide with targeting and/or antimicrobial activity
FLKFLKKFFKKLKY

SEQ ID NO: 1045 - protein, 16 aa, Artificial
  Peptide with targeting and/or antimicrobial activity
GWLKMFKKIIGKFGKF

SEQ ID NO: 1046 - protein, 16 aa, Artificial
  Peptide with targeting and/or antimicrobial activity
GIFKKFVKILYKVQKL

SEQ ID NO: 1047 - protein, 24 aa, Artificial
  Peptide with targeting and/or antimicrobial activity
GRLVLEITADEVKALGEALANAKI

SEQ ID NO: 1048 - protein, 21 aa, Artificial
  Peptide with targeting and/or antimicrobial activity
YIQFHLNQQPRPKVKKIKIFL

SEQ ID NO: 1049 - protein, 32 aa, Artificial; identical to SEQ ID NO: 750
  Peptide with targeting and/or antimicrobial activity

SEQ ID NO: 1050 - protein, 30 aa, Artificial
  Peptide with targeting and/or antimicrobial activity
MRFGSLALVAYDSAIKHSWPRPSSVRRLRM

SEQ ID NO: 1051 - protein, 39 aa, Artificial
  Peptide with targeting and/or antimicrobial activity
FESKILNASKELDKEKKVNTALSFNSHQDFAKAYQNGKI

SEQ ID NO: 1052 - protein, 18 aa, Artificial
  Peptide with targeting and/or antimicrobial activity
WSRVPGHSDTGWKVWHRW

SEQ ID NO: 1053 - protein, 21 aa, Artificial
  Peptide with targeting and/or antimicrobial activity
MGIIAGIIKFIKGLIEKFTGK

SEQ ID NO: 1054 - protein, 16 aa, Artificial
  Peptide with targeting and/or antimicrobial activity
RESKLIAMADMIRRRI

SEQ ID NO: 1055 - protein, 24 aa, Artificial
  Peptide with targeting and/or antimicrobial activity
LSLATFAKIFMTRSNWSLKRFNRL

SEQ ID NO: 1056 - protein, 30 aa, Artificial; identical to SEQ ID NO: 544
  Peptide with targeting and/or antimicrobial activity

SEQ ID NO: 1057 - protein, 37 aa, Artificial; identical to SEQ ID NO: 560
  Peptide with targeting and/or antimicrobial activity

SEQ ID NO: 1058 - protein, 28 aa, Artificial
  Peptide with targeting and/or antimicrobial activity
VLPFPAIPLSRRRACVAAPRPRSRQRAS

SEQ ID NO: 1059 - protein, 30 aa, Artificial
  Peptide with targeting and/or antimicrobial activity
KNKKQTDILEKVKEILDKKKKTKSVGQKLY

SEQ ID NO: 1060 - protein, 15 aa, Artificial
  Peptide with targeting and/or antimicrobial activity
SLQSQLGPCLHDQRH

SEQ ID NO: 1061 - protein, 28 aa, Artificial
  Peptide with targeting and/or antimicrobial activity
KFQGEFTNIGQSYIVSASHMSTSLNTGK

SEQ ID NO: 1062 - protein, 41 aa, Artificial; identical to SEQ ID NO: 808
  Peptide with targeting and/or antimicrobial activity

SEQ ID NO: 1063 - protein, 20 aa, Artificial
  Peptide with targeting and/or antimicrobial activity
KFSDQIDKGQDALKDKLGDL

SEQ ID NO: 1064 - protein, 13 aa, Artificial
  Peptide with targeting and/or antimicrobial activity
LSEMERRRLRKRA

SEQ ID NO: 1065 - protein, 25 aa, Artificial
  Peptide with targeting and/or antimicrobial activity
RRGCTERLRRMARRNAWDLYAEHFY

SEQ ID NO: 1066 - protein, 26 aa, Artificial
  Peptide with targeting and/or antimicrobial activity
SKFKVLRKIIIKEYKGELMLSIQKQR

SEQ ID NO: 1067 - protein, 20 aa, Artificial
  Peptide with targeting and/or antimicrobial activity
FELVDWLETNLGKILKSKSA

SEQ ID NO: 1068 - protein, 22 aa, Artificial
  Peptide with targeting and/or antimicrobial activity
LVLRICTDLFTFIKWTIKQRKS

SEQ ID NO: 1069 - protein, 24 aa, Artificial
  Peptide with targeting and/or antimicrobial activity
VYSFLYVLVIVRKLLSMKKRIERL

SEQ ID NO: 1070 - protein, 18 aa, Artificial
  Peptide with targeting and/or antimicrobial activity
GIVLIGLKLIPLLANVLR

SEQ ID NO: 1071 - protein, 21 aa, Artificial
  Peptide with targeting and/or antimicrobial activity
VMQSLYVKPPLILVTKLAQQN

SEQ ID NO: 1072 - protein, 16 aa, Artificial
  Peptide with targeting and/or antimicrobial activity
SFMPEIQKNTIPTQMK

SEQ ID NO: 1073 - protein, 39 aa, Artificial; identical to SEQ ID NO: 744
  Peptide with targeting and/or antimicrobial activity

SEQ ID NO: 1074 - protein, 15 aa, Artificial
  Peptide with targeting and/or antimicrobial activity
CGKLLEQKNFFLKTR

SEQ ID NO: 1075 - protein, 30 aa, Artificial; identical to SEQ ID NO: 747
  Peptide with targeting and/or antimicrobial activity

SEQ ID NO: 1076 - protein, 24 aa, Artificial
  Peptide with targeting and/or antimicrobial activity
PDAPRTCYHKPILAALSRIVVTDR

SEQ ID NO: 1077 - protein, 8 aa, Artificial
  Peptide with targeting and/or antimicrobial activity
NYAVVSHT

SEQ ID NO: 1078 - protein, 23 aa, Artificial
  Peptide with targeting and/or antimicrobial activity
FQKPFTGEEVEDFQDDDEIPTII

SEQ ID NO: 1079 - protein, 25 aa, Artificial
  Peptide with targeting and/or antimicrobial activity
DSSQSDSDSDSNSSNTNSNSSITNG

SEQ ID NO: 1080 - protein, 25 aa, Artificial
  Peptide with targeting and/or antimicrobial activity
LPGTLHIQAEFPVQLEAGSLIQIFD

SEQ ID NO: 1081 - protein, 24 aa, Artificial
  Peptide with targeting and/or antimicrobial activity
EIPIQLANDLANYYDISLDSIFFW

SEQ ID NO: 1082 - protein, 20 aa, Artificial
  Peptide with targeting and/or antimicrobial activity
RDMTVAGKRPNFLIITTDEE

SEQ ID NO: 1083 - protein, 31 aa, Artificial
  Peptide with targeting and/or antimicrobial activity
NTSIVCAVTFAPIKEVPLLWRAGLTLRSRQS

SEQ ID NO: 1084 - protein, 29 aa, Artificial
  Peptide with targeting and/or antimicrobial activity
QAKVEREVERDLVYTLRRLCDPSGSERTK

SEQ ID NO: 1085 - protein, 29 aa, Artificial
  Peptide with targeting and/or antimicrobial activity
PRMIDIISFHGCHGDHQVWTDPQATALPR

SEQ ID NO: 1086 - protein, 30 aa, Artificial; identical to SEQ ID NO: 326
  Peptide with targeting and/or antimicrobial activity

SEQ ID NO: 1087 - protein, 5 aa, Artificial
  Peptide with targeting and/or antimicrobial activity
NDDAQ

SEQ ID NO: 1088 - protein, 30 aa, Artificial; identical to SEQ ID NO: 328
  Peptide with targeting and/or antimicrobial activity

SEQ ID NO: 1089 - protein, 23 aa, Artificial
  Peptide with targeting and/or antimicrobial activity
ARLSKAIIIAVIVVYHLDVRGLF

SEQ ID NO: 1090 - protein, 30 aa, Artificial; identical to SEQ ID NO: 330
  Peptide with targeting and/or antimicrobial activity

SEQ ID NO: 1091 - protein, 21 aa, Artificial
  Peptide with targeting and/or antimicrobial activity
MGIIAGIIKFIKGLIEKFTGK

SEQ ID NO: 1092 - protein, 21 aa, Artificial
  Peptide with targeting and/or antimicrobial activity
MGIIAGIIKVIKSLIEQFTGK

SEQ ID NO: 1093 - protein, 26 aa, Artificial
  Peptide with targeting and/or antimicrobial activity
MIEIGSIAYLNGGSKKYNHILNQENR

SEQ ID NO: 1094 - protein, 13 aa, Artificial
  Peptide with targeting and/or antimicrobial activity
SKKYNHILNQENR

SEQ ID NO: 1095 - protein, 26 aa, Artificial
  Peptide with targeting and/or antimicrobial activity
MDIDVNKLLQAFVYFKSFEKLRHNNS

SEQ ID NO: 1096 - protein, 30 aa, Artificial; identical to SEQ ID NO: 336
  Peptide with targeting and/or antimicrobial activity

SEQ ID NO: 1097 - protein, 24 aa, Artificial
  Peptide with targeting and/or antimicrobial activity
WRGPNTEAGGKSANNIVQVGGAPT

SEQ ID NO: 1098 - protein, 23 aa, Artificial
  Peptide with targeting and/or antimicrobial activity
LIQKGLNQTFIVVIRLNNFIKKS

SEQ ID NO: 1099 - protein, 14 aa, Artificial
  Peptide with targeting and/or antimicrobial activity
SIDKRNLYNLKYYE

SEQ ID NO: 1100 - protein, 5 aa, Artificial
  Peptide with targeting and/or antimicrobial activity
ESIIE

SEQ ID NO: 1101 - protein, 5 aa, Artificial
  Peptide with targeting and/or antimicrobial activity
NDTNK

SEQ ID NO: 1102 - protein, 30 aa, Artificial; identical to SEQ ID NO: 344
  Peptide with targeting and/or antimicrobial activity

SEQ ID NO: 1103 - protein, 14 aa, Artificial
  Peptide with targeting and/or antimicrobial activity
FSLNFSKQKYVTVN

SEQ ID NO: 1104 - protein, 24 aa, Artificial
  Peptide with targeting and/or antimicrobial activity
MINELKNKNSGIMNNYVVTKESKL

SEQ ID NO: 1105 - protein, 30 aa, Artificial; identical to SEQ ID NO: 347
  Peptide with targeting and/or antimicrobial activity

SEQ ID NO: 1106 - protein, 6 aa, Artificial
  Peptide with targeting and/or antimicrobial activity
DLRKAK

SEQ ID NO: 1107 - protein, 17 aa, Artificial
  Peptide with targeting and/or antimicrobial activity
LLIIFRLWLELKWKNKK

SEQ ID NO: 1108 - protein, 6 aa, Artificial
  Peptide with targeting and/or antimicrobial activity
SIHFIN

SEQ ID NO: 1109 - protein, 25 aa, Artificial
  Peptide with targeting and/or antimicrobial activity
HNARKYLEFISQKIDGDKLTKEDSL

SEQ ID NO: 1110 - protein, 25 aa, Artificial
  Peptide with targeting and/or antimicrobial activity
ALDCSEQSVILWYETILDKIVGVIK

SEQ ID NO: 1111 - protein, 5 aa, Artificial
  Peptide with targeting and/or antimicrobial activity
NSTNE

SEQ ID NO: 1112 - protein, 16 aa, Artificial
  Peptide with targeting and/or antimicrobial activity
MTCHQAPTTTHQSNMA

SEQ ID NO: 1113 - protein, 30 aa, Artificial; identical to SEQ ID NO: 355
  Peptide with targeting and/or antimicrobial activity

SEQ ID NO: 1114 - protein, 21 aa, Artificial
  Peptide with targeting and/or antimicrobial activity
RIVVPAHQSNMASTPNLSITP

SEQ ID NO: 1115 - protein, 30 aa, Artificial; identical to SEQ ID NO: 356
  Peptide with targeting and/or antimicrobial activity

SEQ ID NO: 1116 - protein, 17 aa, Artificial
  Peptide with targeting and/or antimicrobial activity
EPKKKHFPKMESASSEP

SEQ ID NO: 1117 - protein, 6 aa, Artificial
  Peptide with targeting and/or antimicrobial activity
SFYESY

SEQ ID NO: 1118 - protein, 21 aa, Artificial
  Peptide with targeting and/or antimicrobial activity
ILNRLSRIVSNEVTSLIYSLK

SEQ ID NO: 1119 - protein, 30 aa, Artificial; identical to SEQ ID NO: 360
  Peptide with targeting and/or antimicrobial activity

SEQ ID NO: 1120 - protein, 30 aa, Artificial; identical to SEQ ID NO: 363
  Peptide with targeting and/or antimicrobial activity

SEQ ID NO: 1121 - protein, 10 aa, Artificial
  Peptide with targeting and/or antimicrobial activity
ELLVILPGFI

SEQ ID NO: 1122 - protein, 17 aa, Artificial
  Peptide with targeting and/or antimicrobial activity
LLLSYFRYTGALLQSLF

SEQ ID NO: 1123 - protein, 22 aa, Artificial
  Peptide with targeting and/or antimicrobial activity
MIKNETAYQMNELLVIRSAYAK

SEQ ID NO: 1124 - protein, 10 aa, Artificial
  Peptide with targeting and/or antimicrobial activity
LDINDYRSTY

SEQ ID NO: 1125 - protein, 13 aa, Artificial
  Peptide with targeting and/or antimicrobial activity
LDFYLTKHLTLML

SEQ ID NO: 1126 - protein, 20 aa, Artificial
  Peptide with targeting and/or antimicrobial activity
LYFAFKKYQERVNQAPNIEY

SEQ ID NO: 1127 - protein, 12 aa, Artificial
  Peptide with targeting and/or antimicrobial activity
AYYLKRREEKGK

SEQ ID NO: 1128 - protein, 25 aa, Artificial
  Peptide with targeting and/or antimicrobial activity
RFFNFEIKKSTKVDYVFAHVDLSDV

SEQ ID NO: 1129 - protein, 15 aa, Artificial
  Peptide with targeting and/or antimicrobial activity
QELINEAVNLLVKSK

SEQ ID NO: 1130 - protein, 38 aa, Artificial; identical to SEQ ID NO: 376
  Peptide with targeting and/or antimicrobial activity

SEQ ID NO: 1131 - protein, 40 aa, Artificial; identical to SEQ ID NO: 379
  Peptide with targeting and/or antimicrobial activity

SEQ ID NO: 1132 - protein, 22 aa, Artificial
  Peptide with targeting and/or antimicrobial activity
TMIVISIPRFEEYMKARHKKWM

SEQ ID NO: 1133 - protein, 9 aa, Artificial
  Peptide with targeting and/or antimicrobial activity
FADQSQDNA

SEQ ID NO: 1134 - protein, 26 aa, Artificial
  Peptide with targeting and/or antimicrobial activity
TITLKAGIERALHEEVPGVIEVEQVF

SEQ ID NO: 1135 - protein, 24 aa, Artificial
  Peptide with targeting and/or antimicrobial activity
GYNSYKAVQDVKTHSEEQRVTAKK

SEQ ID NO: 1136 - protein, 26 aa, Artificial
  Peptide with targeting and/or antimicrobial activity
IAAIIVLVLFQKGLLQIFNWILIQLQ

SEQ ID NO: 1137 - protein, 6 aa, Artificial
  Peptide with targeting and/or antimicrobial activity
DYYGKE

SEQ ID NO: 1138 - protein, 35 aa, Artificial; identical to SEQ ID NO: 387
  Peptide with targeting and/or antimicrobial activity

SEQ ID NO: 1139 - protein, 37 aa, Artificial; identical to SEQ ID NO: 388
  Peptide with targeting and/or antimicrobial activity

SEQ ID NO: 1140 - protein, 30 aa, Artificial; identical to SEQ ID NO: 389
  Peptide with targeting and/or antimicrobial activity

SEQ ID NO: 1141 - protein, 37 aa, Artificial; identical to SEQ ID NO: 390
  Peptide with targeting and/or antimicrobial activity

SEQ ID NO: 1142 - protein, 21 aa, Artificial
  Peptide with targeting and/or antimicrobial activity
FDPVPLKKDKSASKHSHKHNH

SEQ ID NO: 1143 - protein, 18 aa, Artificial
  Peptide with targeting and/or antimicrobial activity
SMVKSEIVDLLNGEDNDD

SEQ ID NO: 1144 - protein, 30 aa, Artificial; identical to SEQ ID NO: 393
  Peptide with targeting and/or antimicrobial activity

SEQ ID NO: 1145 - protein, 36 aa, Artificial; identical to SEQ ID NO: 394
  Peptide with targeting and/or antimicrobial activity

SEQ ID NO: 1146 - protein, 12 aa, Artificial
  Peptide with targeting and/or antimicrobial activity
RDIHPIYFMTKD

SEQ ID NO: 1147 - protein, 28 aa, Artificial
  Peptide with targeting and/or antimicrobial activity
FVNSLIMKDLSDNDMRFKYEYYNREKDT

SEQ ID NO: 1148 - protein, 27 aa, Artificial
  Peptide with targeting and/or antimicrobial activity
LYQYELLSKEEYLKCTLIINQRRNEQK

SEQ ID NO: 1149 - protein, 13 aa, Artificial
  Peptide with targeting and/or antimicrobial activity
EIIAYLEGRFANA

SEQ ID NO: 1150 - protein, 28 aa, Artificial
  Peptide with targeting and/or antimicrobial activity
TTRPQVAEDRQLDDALKETFPASDPISP

SEQ ID NO: 1151 - protein, 38 aa, Artificial; identical to SEQ ID NO: 403
  Peptide with targeting and/or antimicrobial activity

SEQ ID NO: 1152 - protein, 22 aa, Artificial
  Peptide with targeting and/or antimicrobial activity
YVVGALVILAVAGLIYSMLRKA

SEQ ID NO: 1153 - protein, 30 aa, Artificial; identical to SEQ ID NO: 406
  Peptide with targeting and/or antimicrobial activity

SEQ ID NO: 1154 - protein, 24 aa, Artificial
  Peptide with targeting and/or antimicrobial activity
GIKVVAARFEEIQFSENFDSIILA

SEQ ID NO: 1155 - protein, 17 aa, Artificial
  Peptide with targeting and/or antimicrobial activity
MKLLARDPWVCAWNDIW

SEQ ID NO: 1156 - protein, 13 aa, Artificial
  Peptide with targeting and/or antimicrobial activity
GDPTAGQKPVECP

SEQ ID NO: 1157 - protein, 24 aa, Artificial
  Peptide with targeting and/or antimicrobial activity
PPARPARIPQTPTLHGASLFRQRS

SEQ ID NO: 1158 - protein, 27 aa, Artificial
  Peptide with targeting and/or antimicrobial activity
VLGKGHDLLDVGKTALKSRVFAWLGGS

SEQ ID NO: 1159 - protein, 19 aa, Artificial
  Peptide with targeting and/or antimicrobial activity
ALSKPAIQARTLCRRQDPP

SEQ ID NO: 1160 - protein, 27 aa, Artificial
  Peptide with targeting and/or antimicrobial activity
FHRRVIRASEWALTTRSFSTPLRSAAR

SEQ ID NO: 1161 - protein, 22 aa, Artificial
  Peptide with targeting and/or antimicrobial activity
LSPRPIIVSRRSRADNNNDWSR

SEQ ID NO: 1162 - protein, 16 aa, Artificial
  Peptide with targeting and/or antimicrobial activity
RSGQPVGRPSRRAWLR

SEQ ID NO: 1163 - protein, 24 aa, Artificial
  Peptide with targeting and/or antimicrobial activity
GIVLTGRAGLVSGACSMALGVGLG

SEQ ID NO: 1164 - protein, 25 aa, Artificial
  Peptide with targeting and/or antimicrobial activity
RRGCTERLRRMARRNAWDLYAEHFY

SEQ ID NO: 1165 - protein, 20 aa, Artificial
  Peptide with targeting and/or antimicrobial activity
GKVSVLTRVPRSLGGAPANQ

SEQ ID NO: 1166 - protein, 12 aa, Artificial
  Peptide with targeting and/or antimicrobial activity
GILARADCSQIA

SEQ ID NO: 1167 - protein, 15 aa, Artificial
  Peptide with targeting and/or antimicrobial activity
LITAEQPATAPIAGK

SEQ ID NO: 1168 - protein, 22 aa, Artificial
  Peptide with targeting and/or antimicrobial activity
HTAVVWLAGVSGCVALSHCEPA

SEQ ID NO: 1169 - protein, 19 aa, Artificial
  Peptide with targeting and/or antimicrobial activity
EEVSRALAGIGLGLGCRIG

SEQ ID NO: 1170 - protein, 28 aa, Artificial
  Peptide with targeting and/or antimicrobial activity
VLPFPAIPLSRRRACVAAPRPRSRQRAS

SEQ ID NO: 1171 - protein, 9 aa, Artificial
  Peptide with targeting and/or antimicrobial activity
TQVTLCRTW

SEQ ID NO: 1172 - protein, 11 aa, Artificial
  Peptide with targeting and/or antimicrobial activity
AGRTAIVQGGG

SEQ ID NO: 1173 - protein, 19 aa, Artificial
  Peptide with targeting and/or antimicrobial activity
RRRPAGQRPEKASQAMIAA

SEQ ID NO: 1174 - protein, 19 aa, Artificial
  Peptide with targeting and/or antimicrobial activity
RLTSNQFLTRITPFVFAQH

SEQ ID NO: 1175 - protein, 17 aa, Artificial
  Peptide with targeting and/or antimicrobial activity
EVYSSPTNNVAITVQNN

SEQ ID NO: 1176 - protein, 13 aa, Artificial
  Peptide with targeting and/or antimicrobial activity
SGLGDLGFSSEAK

SEQ ID NO: 1177 - protein, 20 aa, Artificial
  Peptide with targeting and/or antimicrobial activity
DADKNLSLERDRFAWRVAAP

SEQ ID NO: 1178 - protein, 22 aa, Artificial
  Peptide with targeting and/or antimicrobial activity
ARTFAGRLGTRYFGGLMRSTKA

SEQ ID NO: 1179 - protein, 23 aa, Artificial
  Peptide with targeting and/or antimicrobial activity
HFILRKPLLFMIHSLKTGPLDRF

SEQ ID NO: 1180 - protein, 21 aa, Artificial
  Peptide with targeting and/or antimicrobial activity
QFCNFAWLFLASNNAQVSALA

SEQ ID NO: 1181 - protein, 11 aa, Artificial
  Peptide with targeting and/or antimicrobial activity
VEEDEAPPPHY

SEQ ID NO: 1182 - protein, 20 aa, Artificial
  Peptide with targeting and/or antimicrobial activity
TTARYIRRQCHTSITPLSQG

SEQ ID NO: 1183 - protein, 17 aa, Artificial
  Peptide with targeting and/or antimicrobial activity
FPAFSFGAIAGSVSVAR

SEQ ID NO: 1184 - protein, 9 aa, Artificial
  Peptide with targeting and/or antimicrobial activity
SWKCHHLAI

SEQ ID NO: 1185 - protein, 23 aa, Artificial
  Peptide with targeting and/or antimicrobial activity
ALQKQDMNLPSVKNQLVFLKSTG

SEQ ID NO: 1186 - protein, 23 aa, Artificial
  Peptide with targeting and/or antimicrobial activity
DAYHCHLVRSPDAHDLSMRIGFV

SEQ ID NO: 1187 - protein, 8 aa, Artificial
  Peptide with targeting and/or antimicrobial activity
NYAVVSHT

SEQ ID NO: 1188 - protein, 7 aa, Artificial
  Peptide with targeting and/or antimicrobial activity
NDSKASN

SEQ ID NO: 1189 - protein, 25 aa, Artificial
  Peptide with targeting and/or antimicrobial activity
ELKITNYNVNTVLYRYYKWGNDLCE

SEQ ID NO: 1190 - protein, 23 aa, Artificial
  Peptide with targeting and/or antimicrobial activity
VDPADDGTRHIRPEDGDPIEIDE

SEQ ID NO: 1191 - protein, 13 aa, Artificial
  Peptide with targeting and/or antimicrobial activity
DYFYITLSQKNTF

SEQ ID NO: 1192 - protein, 38 aa, Artificial; identical to SEQ ID NO: 501
  Peptide with targeting and/or antimicrobial activity

SEQ ID NO: 1193 - protein, 27 aa, Artificial
  Peptide with targeting and/or antimicrobial activity
DANAMARTTIAIVYILALIALTISYSL

SEQ ID NO: 1194 - protein, 8 aa, Artificial
  Peptide with targeting and/or antimicrobial activity
RTPYILRS

SEQ ID NO: 1195 - protein, 32 aa, Artificial; identical to SEQ ID NO: 509
  Peptide with targeting and/or antimicrobial activity

SEQ ID NO: 1196 - protein, 9 aa, Artificial
  Peptide with targeting and/or antimicrobial activity
INSRYKISF

SEQ ID NO: 1197 - protein, 26 aa, Artificial
  Peptide with targeting and/or antimicrobial activity
SEDIFGRLANEKANGLEELRKIRLKQ

SEQ ID NO: 1198 - protein, 24 aa, Artificial
  Peptide with targeting and/or antimicrobial activity
DHKINESQHNPFRSDSNKQNVDFF

SEQ ID NO: 1199 - protein, 38 aa, Artificial; identical to SEQ ID NO: 527
  Peptide with targeting and/or antimicrobial activity

SEQ ID NO: 1200 - protein, 40 aa, Artificial
  Peptide with targeting and/or antimicrobial activity
MQSLSNRQSLIASYILMGIFLSFGYPPASLSKFFCRLSHL

SEQ ID NO: 1201 - protein, 42 aa, Artificial; identical to SEQ ID NO: 535
  Peptide with targeting and/or antimicrobial activity

SEQ ID NO: 1202 - protein, 9 aa, Artificial
  Peptide with targeting and/or antimicrobial activity
AAQPQTTSP

SEQ ID NO: 1203 - protein, 23 aa, Artificial
  Peptide with targeting and/or antimicrobial activity
LVGALLIFVALIYMVLKGNADKN

SEQ ID NO: 1204 - protein, 40 aa, Artificial
  Peptide with targeting and/or antimicrobial activity
SIQEAEKIIKNDPFYIHDVADYDFMWFEPSKSLEEIKEFV

SEQ ID NO: 1205 - protein, 17 aa, Artificial
  Peptide with targeting and/or antimicrobial activity
LDLALSTNSLNLEGFSF

SEQ ID NO: 1206 - protein, 24 aa, Artificial
  Peptide with targeting and/or antimicrobial activity
LSLATFAKIFMTRSNWSLKRFNRL

SEQ ID NO: 1207 - protein, 30 aa, Artificial; identical to SEQ ID NO: 544
  Peptide with targeting and/or antimicrobial activity

SEQ ID NO: 1208 - protein, 30 aa, Artificial; identical to SEQ ID NO: 548
  Peptide with targeting and/or antimicrobial activity

SEQ ID NO: 1209 - protein, 15 aa, Artificial
  Peptide with targeting and/or antimicrobial activity
MVHDMTNGTLIIVKH

SEQ ID NO: 1210 - protein, 19 aa, Artificial
  Peptide with targeting and/or antimicrobial activity
SFVSTTVRLIFEESKRYKF

SEQ ID NO: 1211 - protein, 5 aa, Artificial
  Peptide with targeting and/or antimicrobial activity
YDPLK

SEQ ID NO: 1212 - protein, 21 aa, Artificial
  Peptide with targeting and/or antimicrobial activity
DFLVNFLWFKGELNWGKKRYK

SEQ ID NO: 1213 - protein, 32 aa, Artificial
  Peptide with targeting and/or antimicrobial activity
GAFGMPSIKTNTICGEKGKFISACDAWLSNLK

SEQ ID NO: 1214 - protein, 28 aa, Artificial
  Peptide with targeting and/or antimicrobial activity
ISKGIDDIVYVINKILSIGNIFKIIKRK

SEQ ID NO: 1215 - protein, 18 aa, Artificial
  Peptide with targeting and/or antimicrobial activity
GIVLIGLKLIPLLANVLN

SEQ ID NO: 1216 - protein, 19 aa, Artificial
  Peptide with targeting and/or antimicrobial activity
EYPWSWISEPWPWDKSFYK

SEQ ID NO: 1217 - protein, 36 aa, Artificial; identical to SEQ ID NO: 558
  Peptide with targeting and/or antimicrobial activity

SEQ ID NO: 1218 - protein, 28 aa, Artificial
  Peptide with targeting and/or antimicrobial activity
GCILPHKKDNYNYIMSKFQDLVKITSKK

SEQ ID NO: 1219 - protein, 37 aa, Artificial; identical to SEQ ID NO: 560
  Peptide with targeting and/or antimicrobial activity

SEQ ID NO: 1220 - protein, 18 aa, Artificial
  Peptide with targeting and/or antimicrobial activity
GVALIGTILVPLLSGLFG

SEQ ID NO: 1221 - protein, 32 aa, Artificial; identical to SEQ ID NO: 564
  Peptide with targeting and/or antimicrobial activity

SEQ ID NO: 1222 - protein, 35 aa, Artificial
  Peptide with targeting and/or antimicrobial activity
MGRHLWNPSYFVATVSENTEEQIRKYINNQKKQVK

SEQ ID NO: 1223 - protein, 41 aa, Artificial; identical to SEQ ID NO: 567
  Peptide with targeting and/or antimicrobial activity

SEQ ID NO: 1224 - protein, 18 aa, Artificial
  Peptide with targeting and/or antimicrobial activity
GIVLIGLKLIPLLANVLR

SEQ ID NO: 1225 - protein, 22 aa, Artificial
  Peptide with targeting and/or antimicrobial activity
AAYPIEDWSDWYEDFFIMLSNI

SEQ ID NO: 1226 - protein, 15 aa, Artificial
  Peptide with targeting and/or antimicrobial activity
KKIDILINKYMYLSK

SEQ ID NO: 1227 - protein, 16 aa, Artificial
  Peptide with targeting and/or antimicrobial activity
AFSGVYKTLIVYTRRK

SEQ ID NO: 1228 - protein, 22 aa, Artificial
  Peptide with targeting and/or antimicrobial activity
DERLPEAKAIRNFNGSVMVLGR

SEQ ID NO: 1229 - protein, 15 aa, Artificial
  Peptide with targeting and/or antimicrobial activity
GIFTGVTVVVSLKHC

SEQ ID NO: 1230 - protein, 30 aa, Artificial; identical to SEQ ID NO: 584
  Peptide with targeting and/or antimicrobial activity

SEQ ID NO: 1231 - protein, 10 aa, Artificial
  Peptide with targeting and/or antimicrobial activity
LAVILRAIVY

SEQ ID NO: 1232 - protein, 19 aa, Artificial
  Peptide with targeting and/or antimicrobial activity
FTFSKCRASNGRGFGTLWL

SEQ ID NO: 1233 - protein, 15 aa, Artificial
  Peptide with targeting and/or antimicrobial activity
WIAIGLLLYFSLKNQ

SEQ ID NO: 1234 - protein, 21 aa, Artificial
  Peptide with targeting and/or antimicrobial activity
VSIKIGAIVIGMIGLMELLTE

SEQ ID NO: 1235 - protein, 30 aa, Artificial; identical to SEQ ID NO: 592
  Peptide with targeting and/or antimicrobial activity

SEQ ID NO: 1236 - protein, 30 aa, Artificial; identical to SEQ ID NO: 595
  Peptide with targeting and/or antimicrobial activity

SEQ ID NO: 1237 - protein, 17 aa, Artificial
  Peptide with targeting and/or antimicrobial activity
NIERILKEKVWMIRCVE

SEQ ID NO: 1238 - protein, 25 aa, Artificial
  Peptide with targeting and/or antimicrobial activity
SMLSVTVMCLMHASVAANQAMEKKV

SEQ ID NO: 1239 - protein, 19 aa, Artificial
  Peptide with targeting and/or antimicrobial activity
ALCSVIKAIELGIINVHLQ

SEQ ID NO: 1240 - protein, 30 aa, Artificial; identical to SEQ ID NO: 604
  Peptide with targeting and/or antimicrobial activity

SEQ ID NO: 1241 - protein, 16 aa, Artificial
  Peptide with targeting and/or antimicrobial activity
VIFLHKESGNLKEIFY

SEQ ID NO: 1242 - protein, 8 aa, Artificial
  Peptide with targeting and/or antimicrobial activity
HFYLLFER

SEQ ID NO: 1243 - protein, 20 aa, Artificial
  Peptide with targeting and/or antimicrobial activity
HLFFVKGMFILCQKNQINDE

SEQ ID NO: 1244 - protein, 30 aa, Artificial; identical to SEQ ID NO: 610
  Peptide with targeting and/or antimicrobial activity

SEQ ID NO: 1245 - protein, 27 aa, Artificial
  Peptide with targeting and/or antimicrobial activity
MTVFEALMLAIAFATLIVKISNKNDKK

SEQ ID NO: 1246 - protein, 21 aa, Artificial
  Peptide with targeting and/or antimicrobial activity
ESAKSNLNFLMQEEWALFLLL

SEQ ID NO: 1247 - protein, 23 aa, Artificial
  Peptide with targeting and/or antimicrobial activity
VFVVLFIIYLASKLLTKLFPIKK

SEQ ID NO: 1248 - protein, 16 aa, Artificial
  Peptide with targeting and/or antimicrobial activity
KKIIPLITLFVVTLVG

SEQ ID NO: 1249 - protein, 24 aa, Artificial
  Peptide with targeting and/or antimicrobial activity
QGANPCQQVGFTVNDPDCRLAKTV

SEQ ID NO: 1250 - protein, 21 aa, Artificial
  Peptide with targeting and/or antimicrobial activity
KYKCSWCKRVYTLRKDHKTAR

SEQ ID NO: 1251 - protein, 12 aa, Artificial
  Peptide with targeting and/or antimicrobial activity
WSEIEINTKQSN

SEQ ID NO: 1252 - protein, 25 aa, Artificial
  Peptide with targeting and/or antimicrobial activity
MIKKSILKIKYYVPVLISLTLILSA

SEQ ID NO: 1253 - protein, 20 aa, Artificial
  Peptide with targeting and/or antimicrobial activity
FTLTLITTIVAILNYKDKKK

SEQ ID NO: 1254 - protein, 29 aa, Artificial
  Peptide with targeting and/or antimicrobial activity
GAVGIAFFAGNMKQDKRIADRQNKKSEKK

SEQ ID NO: 1255 - protein, 36 aa, Artificial; identical to SEQ ID NO: 623
  Peptide with targeting and/or antimicrobial activity

SEQ ID NO: 1256 - protein, 14 aa, Artificial
  Peptide with targeting and/or antimicrobial activity
VVAYVITQVGAIRF

SEQ ID NO: 1257 - protein, 14 aa, Artificial
  Peptide with targeting and/or antimicrobial activity
DPAGCNDIVRKYCK

SEQ ID NO: 1258 - protein, 14 aa, Artificial
  Peptide with targeting and/or antimicrobial activity
DLVQSILSEFKKSG

SEQ ID NO: 1259 - protein, 10 aa, Artificial
  Peptide with targeting and/or antimicrobial activity
VLKEECYQKN

SEQ ID NO: 1260 - protein, 16 aa, Artificial
  Peptide with targeting and/or antimicrobial activity
YCVPLGNMGNMNNKIW

SEQ ID NO: 1261 - protein, 28 aa, Artificial
  Peptide with targeting and/or antimicrobial activity
LIYTILASLGVLTVLQAILGREPKAVKA

SEQ ID NO: 1262 - protein, 10 aa, Artificial
  Peptide with targeting and/or antimicrobial activity
VEDLMEDLNA

SEQ ID NO: 1263 - protein, 25 aa, Artificial
  Peptide with targeting and/or antimicrobial activity
ILVVLAGILLVVLSYVGISKFKMNC

SEQ ID NO: 1264 - protein, 25 aa, Artificial
  Peptide with targeting and/or antimicrobial activity
FPIISALLGAIICIAIYSFIVNRKA

SEQ ID NO: 1265 - protein, 25 aa, Artificial
  Peptide with targeting and/or antimicrobial activity
YWLSRVTTGHSFAFEKPVPLSLTIK

SEQ ID NO: 1266 - protein, 25 aa, Artificial
  Peptide with targeting and/or antimicrobial activity
LLSTEQLLKYYDGETFDGFQLPSNE

SEQ ID NO: 1267 - protein, 9 aa, Artificial
  Peptide with targeting and/or antimicrobial activity
VLYFQATVV

SEQ ID NO: 1268 - protein, 18 aa, Artificial
  Peptide with targeting and/or antimicrobial activity
LVRIEVDDLEEWYERNFI

SEQ ID NO: 1269 - protein, 27 aa, Artificial
  Peptide with targeting and/or antimicrobial activity
YLEMNADYLSNMDIFDELWEKYLENNK

SEQ ID NO: 1270 - protein, 20 aa, Artificial
  Peptide with targeting and/or antimicrobial activity
KPKNKKEKTVISYEKLLSMY

SEQ ID NO: 1271 - protein, 16 aa, Artificial
  Peptide with targeting and/or antimicrobial activity
YCVPLGNMGNMNNKIW

SEQ ID NO: 1272 - protein, 18 aa, Artificial
  Peptide with targeting and/or antimicrobial activity
FALELIALCRNLFIVYFP

SEQ ID NO: 1273 - protein, 17 aa, Artificial
  Peptide with targeting and/or antimicrobial activity
WVAVAILLNIALQTQLT

SEQ ID NO: 1274 - protein, 22 aa, Artificial
  Peptide with targeting and/or antimicrobial activity
TFAGSIKIGVPDLVHVTFNCKR

SEQ ID NO: 1275 - protein, 7 aa, Artificial
  Peptide with targeting and/or antimicrobial activity
LLNKKLE

SEQ ID NO: 1276 - protein, 30 aa, Artificial
  Peptide with targeting and/or antimicrobial activity
MIDVTIGQKSKTGAFNASYSICFSGENFSF

SEQ ID NO: 1277 - protein, 16 aa, Artificial
  Peptide with targeting and/or antimicrobial activity
SKAGLYGKIERSDKRE

SEQ ID NO: 1278 - protein, 6 aa, Artificial
  Peptide with targeting and/or antimicrobial activity
DSYFRS

SEQ ID NO: 1279 - protein, 22 aa, Artificial
  Peptide with targeting and/or antimicrobial activity
FFLVHFYIRKRKGKVSIFLNYF

SEQ ID NO: 1280 - protein, 13 aa, Artificial
  Peptide with targeting and/or antimicrobial activity
VVTGKVGSLPQIK

SEQ ID NO: 1281 - protein, 13 aa, Artificial
  Peptide with targeting and/or antimicrobial activity
KHCFEITDKTDVV

SEQ ID NO: 1282 - protein, 30 aa, Artificial; identical to SEQ ID NO: 652
  Peptide with targeting and/or antimicrobial activity

SEQ ID NO: 1283 - protein, 21 aa, Artificial
  Peptide with targeting and/or antimicrobial activity
AGKKERLLSFREQFLNKNKKK

SEQ ID NO: 1284 - protein, 17 aa, Artificial
  Peptide with targeting and/or antimicrobial activity
IAAFVTSRAFSDTVSPI

SEQ ID NO: 1285 - protein, 30 aa, Artificial; identical to SEQ ID NO: 655
  Peptide with targeting and/or antimicrobial activity

SEQ ID NO: 1286 - protein, 30 aa, Artificial; identical to SEQ ID NO: 656
  Peptide with targeting and/or antimicrobial activity

SEQ ID NO: 1287 - protein, 20 aa, Artificial
  Peptide with targeting and/or antimicrobial activity
YVLEYHGLRATQDVDAFMAL

SEQ ID NO: 1288 - protein, 7 aa, Artificial
  Peptide with targeting and/or antimicrobial activity
ENEESIF

SEQ ID NO: 1289 - protein, 15 aa, Artificial
  Peptide with targeting and/or antimicrobial activity
AATLICVGSGIMSSL

SEQ ID NO: 1290 - protein, 13 aa, Artificial
  Peptide with targeting and/or antimicrobial activity
AVVCGYLAYTATS

SEQ ID NO: 1291 - protein, 9 aa, Artificial
  Peptide with targeting and/or antimicrobial activity
VAYAAICWW

SEQ ID NO: 1292 - protein, 13 aa, Artificial
  Peptide with targeting and/or antimicrobial activity
FNGDSEFFLCIAF

SEQ ID NO: 1293 - protein, 27 aa, Artificial
  Peptide with targeting and/or antimicrobial activity
MRKEFHNVLSSGQLLADKRPARDYNRK

SEQ ID NO: 1294 - protein, 16 aa, Artificial
  Peptide with targeting and/or antimicrobial activity
GQLLADKRPARDYNRK

SEQ ID NO: 1295 - protein, 23 aa, Artificial
  Peptide with targeting and/or antimicrobial activity
FQKPFTGEEVEDFQDDDEIPTII

SEQ ID NO: 1296 - protein, 25 aa, Artificial
  Peptide with targeting and/or antimicrobial activity
RVLVLKKFHGIMDGNRNVAVFFVGQ

SEQ ID NO: 1297 - protein, 30 aa, Artificial; identical to SEQ ID NO: 669
  Peptide with targeting and/or antimicrobial activity

SEQ ID NO: 1298 - protein, 30 aa, Artificial; identical to SEQ ID NO: 671
  Peptide with targeting and/or antimicrobial activity

SEQ ID NO: 1299 - protein, 21 aa, Artificial
  Peptide with targeting and/or antimicrobial activity
KLLYFFNYFENLQQVHLLVQL

SEQ ID NO: 1300 - protein, 30 aa, Artificial; identical to SEQ ID NO: 673
  Peptide with targeting and/or antimicrobial activity

SEQ ID NO: 1301 - protein, 14 aa, Artificial
  Peptide with targeting and/or antimicrobial activity
ASMTKRLKLAMSKV

SEQ ID NO: 1302 - protein, 6 aa, Artificial
  Peptide with targeting and/or antimicrobial activity
SGNEKV

SEQ ID NO: 1303 - protein, 22 aa, Artificial
  Peptide with targeting and/or antimicrobial activity
IDKSRNKDQFSHIFGLYNICSG

SEQ ID NO: 1304 - protein, 15 aa, Artificial
  Peptide with targeting and/or antimicrobial activity
SLQSQLGPCLHDQRH

SEQ ID NO: 1305 - protein, 21 aa, Artificial
  Peptide with targeting and/or antimicrobial activity
MPTTKSKQKGWTNTKKASNTQ

SEQ ID NO: 1306 - protein, 13 aa, Artificial
  Peptide with targeting and/or antimicrobial activity
HRNLIILQRTIFI

SEQ ID NO: 1307 - protein, 30 aa, Artificial; identical to SEQ ID NO: 679
  Peptide with targeting and/or antimicrobial activity

SEQ ID NO: 1308 - protein, 30 aa, Artificial; identical to SEQ ID NO: 328
  Peptide with targeting and/or antimicrobial activity

SEQ ID NO: 1309 - protein, 11 aa, Artificial
  Peptide with targeting and/or antimicrobial activity
IIQDIAHAFGY

SEQ ID NO: 1310 - protein, 30 aa, Artificial; identical to SEQ ID NO: 682
  Peptide with targeting and/or antimicrobial activity

SEQ ID NO: 1311 - protein, 30 aa, Artificial
  Peptide with targeting and/or antimicrobial activity
MARNDDDIKKIKGTLGQSPEVYGERKLPYT

SEQ ID NO: 1312 - protein, 9 aa, Artificial
  Peptide with targeting and/or antimicrobial activity
TCVKPRTIN

SEQ ID NO: 1313 - protein, 8 aa, Artificial
  Peptide with targeting and/or antimicrobial activity
INKYHHIA

SEQ ID NO: 1314 - protein, 25 aa, Artificial
  Peptide with targeting and/or antimicrobial activity
ISLIIFIMLFVVALFKCITNYKHQS

SEQ ID NO: 1315 - protein, 16 aa, Artificial
  Peptide with targeting and/or antimicrobial activity
EKRMSFNENQSHRPLL

SEQ ID NO: 1316 - protein, 30 aa, Artificial; identical to SEQ ID NO: 687
  Peptide with targeting and/or antimicrobial activity

SEQ ID NO: 1317 - protein, 30 aa, Artificial; identical to SEQ ID NO: 688
  Peptide with targeting and/or antimicrobial activity

SEQ ID NO: 1318 - protein, 7 aa, Artificial
  Peptide with targeting and/or antimicrobial activity
KNKTDTL

SEQ ID NO: 1319 - protein, 10 aa, Artificial
  Peptide with targeting and/or antimicrobial activity
VDMVNRFLGN

SEQ ID NO: 1320 - protein, 25 aa, Artificial
  Peptide with targeting and/or antimicrobial activity
KPVGKALEEIADGKIEPVVPKEYLG

SEQ ID NO: 1321 - protein, 6 aa, Artificial
  Peptide with targeting and/or antimicrobial activity
VRKSDQ

SEQ ID NO: 1322 - protein, 9 aa, Artificial
  Peptide with targeting and/or antimicrobial activity
YYKDYFKEI

SEQ ID NO: 1323 - protein, 12 aa, Artificial
  Peptide with targeting and/or antimicrobial activity
EDNKDKKDKKDK

SEQ ID NO: 1324 - protein, 17 aa, Artificial
  Peptide with targeting and/or antimicrobial activity
YKVNYNNIDNHFNTLRH

SEQ ID NO: 1325 - protein, 18 aa, Artificial
  Peptide with targeting and/or antimicrobial activity
PYSDSYATRPHWEQHRAR

SEQ ID NO: 1326 - protein, 30 aa, Artificial; identical to SEQ ID NO: 697
  Peptide with targeting and/or antimicrobial activity

SEQ ID NO: 1327 - protein, 30 aa, Artificial; identical to SEQ ID NO: 698
  Peptide with targeting and/or antimicrobial activity

SEQ ID NO: 1328 - protein, 25 aa, Artificial
  Peptide with targeting and/or antimicrobial activity
MAADIISTIGDLVKWIIDTVNKFKK

SEQ ID NO: 1329 - protein, 30 aa, Artificial; identical to SEQ ID NO: 700
  Peptide with targeting and/or antimicrobial activity

SEQ ID NO: 1330 - protein, 30 aa, Artificial; identical to SEQ ID NO: 701
  Peptide with targeting and/or antimicrobial activity

SEQ ID NO: 1331 - protein, 14 aa, Artificial
  Peptide with targeting and/or antimicrobial activity
WADAQYKLCENCSE

SEQ ID NO: 1332 - protein, 12 aa, Artificial
  Peptide with targeting and/or antimicrobial activity
HKNKLNIPHIKS

SEQ ID NO: 1333 - protein, 20 aa, Artificial
  Peptide with targeting and/or antimicrobial activity
HLFILKSHLKPFPPFRYTYD

SEQ ID NO: 1334 - protein, 12 aa, Artificial
  Peptide with targeting and/or antimicrobial activity
AYILKRREEKNK

SEQ ID NO: 1335 - protein, 30 aa, Artificial; identical to SEQ ID NO: 706
  Peptide with targeting and/or antimicrobial activity

SEQ ID NO: 1336 - protein, 17 aa, Artificial
  Peptide with targeting and/or antimicrobial activity
LVGYVRTSGTVRSYKIN

SEQ ID NO: 1337 - protein, 12 aa, Artificial
  Peptide with targeting and/or antimicrobial activity
HKKDIRKQVFKN

SEQ ID NO: 1338 - protein, 12 aa, Artificial
  Peptide with targeting and/or antimicrobial activity
KNSMSRSIALID

SEQ ID NO: 1339 - protein, 21 aa, Artificial
  Peptide with targeting and/or antimicrobial activity
VMQSLYVKPPLILVTKLAQQN

SEQ ID NO: 1340 - protein, 16 aa, Artificial
  Peptide with targeting and/or antimicrobial activity
SFMPEIQKNTIPTQMK

SEQ ID NO: 1341 - protein, 16 aa, Artificial
  Peptide with targeting and/or antimicrobial activity
SNGVGLGVGIGSGIRF

SEQ ID NO: 1342 - protein, 24 aa, Artificial
  Peptide with targeting and/or antimicrobial activity
QRFYKLFYHIDLTNEQALKLFQVK

SEQ ID NO: 1343 - protein, 21 aa, Artificial
  Peptide with targeting and/or antimicrobial activity
DKSTQDKDIKQAKLLAQELGL

SEQ ID NO: 1344 - protein, 16 aa, Artificial
  Peptide with targeting and/or antimicrobial activity
ASKQASKQASKQASKQ

SEQ ID NO: 1345 - protein, 14 aa, Artificial
  Peptide with targeting and/or antimicrobial activity
VKPTMTASLISTVC

SEQ ID NO: 1346 - protein, 21 aa, Artificial
  Peptide with targeting and/or antimicrobial activity
SFYSKYSRYIDNLAGAIFLFF

SEQ ID NO: 1347 - protein, 14 aa, Artificial
  Peptide with targeting and/or antimicrobial activity
YLVYSGVLATAAAF

SEQ ID NO: 1348 - protein, 39 aa, Artificial; identical to SEQ ID NO: 744
  Peptide with targeting and/or antimicrobial activity

SEQ ID NO: 1349 - protein, 15 aa, Artificial
  Peptide with targeting and/or antimicrobial activity
CGKLLEQKNFFLKTR

SEQ ID NO: 1350 - protein, 20 aa, Artificial
  Peptide with targeting and/or antimicrobial activity
FELVDWLETNLGKILKSKSA

SEQ ID NO: 1351 - protein, 24 aa, Artificial
  Peptide with targeting and/or antimicrobial activity
PDAPRTCYHKPILAALSRIVVTDR

SEQ ID NO: 1352 - protein, 20 aa, Artificial
  Peptide with targeting and/or antimicrobial activity
KFSDQIDKGQDALKDKLGDL

SEQ ID NO: 1353 - protein, 15 aa, Artificial
  Peptide with targeting and/or antimicrobial activity
VLLLFIFQPFQKQLL

SEQ ID NO: 1354 - protein, 32 aa, Artificial; identical to SEQ ID NO: 750
  Peptide with targeting and/or antimicrobial activity

SEQ ID NO: 1355 - protein, 17 aa, Artificial
  Peptide with targeting and/or antimicrobial activity
LVDVVVLIRRHLPKSCS

SEQ ID NO: 1356 - protein, 13 aa, Artificial
  Peptide with targeting and/or antimicrobial activity
LSEMERRRLRKRA

SEQ ID NO: 1357 - protein, 26 aa, Artificial
  Peptide with targeting and/or antimicrobial activity
SKFKVLRKIIIKEYKGELMLSIQKQR

SEQ ID NO: 1358 - protein, 21 aa, Artificial
  Peptide with targeting and/or antimicrobial activity
YIQFHLNQQPRPKVKKIKIFL

SEQ ID NO: 1359 - protein, 26 aa, Artificial
  Peptide with targeting and/or antimicrobial activity
KFIYKYKLSFIIYKILIQTLTMELNK

SEQ ID NO: 1360 - protein, 18 aa, Artificial
  Peptide with targeting and/or antimicrobial activity
KTPNDKIHKTIIIKHIIL

SEQ ID NO: 1361 - protein, 26 aa, Artificial
  Peptide with targeting and/or antimicrobial activity
KYFHLFYHNIIHYSKQHLSLKVDFKN

SEQ ID NO: 1362 - protein, 19 aa, Artificial
  Peptide with targeting and/or antimicrobial activity
NIKTRKRALKIIKQHQRSK

SEQ ID NO: 1363 - protein, 21 aa, Artificial
  Peptide with targeting and/or antimicrobial activity
MEPIPHIMIIANQIGIIIEKA

SEQ ID NO: 1364 - protein, 13 aa, Artificial
  Peptide with targeting and/or antimicrobial activity
LANDYYKKTKKSW

SEQ ID NO: 1365 - protein, 30 aa, Artificial; identical to SEQ ID NO: 1059
  Peptide with targeting and/or antimicrobial activity

SEQ ID NO: 1366 - protein, 27 aa, Artificial
  Peptide with targeting and/or antimicrobial activity
SIILTKKKRRKIPLSIDSQIYKYTFKQ

SEQ ID NO: 1367 - protein, 19 aa, Artificial
  Peptide with targeting and/or antimicrobial activity
KSILILIKVIFIGQTTIIL

SEQ ID NO: 1368 - protein, 26 aa, Artificial
  Peptide with targeting and/or antimicrobial activity
RRNLNSPNIKTRKRALKIIKQHQRSK

SEQ ID NO: 1369 - protein, 23 aa, Artificial
  Peptide with targeting and/or antimicrobial activity
KKDNPSLNDQDKNAVLNLLALAK

SEQ ID NO: 1370 - protein, 26 aa, Artificial
  Peptide with targeting and/or antimicrobial activity
NILFGIIGFVVAMTAAVIVTAISIAK

SEQ ID NO: 1371 - protein, 17 aa, Artificial
  Peptide with targeting and/or antimicrobial activity
FGEKQMRSWWKVHWFHP

SEQ ID NO: 1372 - protein, 16 aa, Artificial
  Peptide with targeting and/or antimicrobial activity
RESKLIAMADMIRRRI

SEQ ID NO: 1373 - protein, 12 aa, Artificial
  Peptide with targeting and/or antimicrobial activity
PIIAPTIKTQIQ

SEQ ID NO: 1374 - protein, 18 aa, Artificial
  Peptide with targeting and/or antimicrobial activity
WSRVPGHSDTGWKVWHRW

SEQ ID NO: 1375 - protein, 26 aa, Artificial
  Peptide with targeting and/or antimicrobial activity
ARPIADLIHFNSTTVTASGDVYYGPG

SEQ ID NO: 1376 - protein, 16 aa, Artificial
  Peptide with targeting and/or antimicrobial activity
TGIGPIARPIEHGLDS

SEQ ID NO: 1377 - protein, 25 aa, Artificial
  Peptide with targeting and/or antimicrobial activity
STENGWQEFESYADVGVDPRRYVPL

SEQ ID NO: 1378 - protein, 27 aa, Artificial
  Peptide with targeting and/or antimicrobial activity
QVKEKRREIELQFRDAEKKLEASVQAE

SEQ ID NO: 1379 - protein, 24 aa, Artificial
  Peptide with targeting and/or antimicrobial activity
ELDKADAALGPAKNLAPLDVINRS

SEQ ID NO: 1380 - protein, 26 aa, Artificial
  Peptide with targeting and/or antimicrobial activity
LTIVGNALQQKNQKLLLNQKKITSLG

SEQ ID NO: 1381 - protein, 25 aa, Artificial
  Peptide with targeting and/or antimicrobial activity
AKNFLTRTAEEIGEQAVREGNINGP

SEQ ID NO: 1382 - protein, 28 aa, Artificial
  Peptide with targeting and/or antimicrobial activity
EAYMRFLDREMEGLTAAYNVKLFTEAIS

SEQ ID NO: 1383 - protein, 19 aa, Artificial
  Peptide with targeting and/or antimicrobial activity
SLQIRMNTLTAAKASIEAA

SEQ ID NO: 1384 - protein, 22 aa, Artificial
  Peptide with targeting and/or antimicrobial activity
AANKAREQAAAEAKRKAEEQAR

SEQ ID NO: 1385 - protein, 12 aa, Artificial
  Peptide with targeting and/or antimicrobial activity
ADAPPPLIVRYS

SEQ ID NO: 1386 - protein, 25 aa, Artificial
  Peptide with targeting and/or antimicrobial activity
SRPGKPGGVSIDVSRDRQDILSNYP

SEQ ID NO: 1387 - protein, 20 aa, Artificial
  Peptide with targeting and/or antimicrobial activity
FGNPFRGFTLAMEADFKKRK

SEQ ID NO: 1388 - protein, 25 aa, Artificial
  Peptide with targeting and/or antimicrobial activity
ESLEADVQAELDTEAAKYPALPASF

SEQ ID NO: 1389 - protein, 20 aa, Artificial
  Peptide with targeting and/or antimicrobial activity
TPEQWLERSTVVVTGLLNRK

SEQ ID NO: 1390 - protein, 25 aa, Artificial
  Peptide with targeting and/or antimicrobial activity
RPELDNELDVVQNSASLDKLQASYN

SEQ ID NO: 1391 - protein, 25 aa, Artificial
  Peptide with targeting and/or antimicrobial activity
TIILNDQINSLQERLNKLNAETDRR

SEQ ID NO: 1392 - protein, 24 aa, Artificial
  Peptide with targeting and/or antimicrobial activity
RAEAEAQRQAEADAKRKAEEAARL

SEQ ID NO: 1393 - protein, 24 aa, Artificial
  Peptide with targeting and/or antimicrobial activity
EAQQVTQQLGADFNAITTPTATKV

SEQ ID NO: 1394 - protein, 25 aa, Artificial
  Peptide with targeting and/or antimicrobial activity
QQRVKAVDASLSQVSTQVSGAVASA

SEQ ID NO: 1395 - protein, 24 aa, Artificial
  Peptide with targeting and/or antimicrobial activity
KSKISEYTEKEFLEFVEDIYTNNK

SEQ ID NO: 1396 - protein, 24 aa, Artificial
  Peptide with targeting and/or antimicrobial activity
SDLLYYPNENREDSPAGVVKEVKE

SEQ ID NO: 1397 - protein, 13 aa, Artificial
  Peptide with targeting and/or antimicrobial activity
WRASKGLPGFKAG

SEQ ID NO: 1398 - protein, 23 aa, Artificial
  Peptide with targeting and/or antimicrobial activity
EKKLIVKLIDSIGKSHEEIVGAG

SEQ ID NO: 1399 - protein, 26 aa, Artificial
  Peptide with targeting and/or antimicrobial activity
LVKSGKLESPYEHSEHLTLSQEKGLE

SEQ ID NO: 1400 - protein, 25 aa, Artificial
  Peptide with targeting and/or antimicrobial activity
LNFRAENKILEKIHISLIDTVEGSA

SEQ ID NO: 1401 - protein, 25 aa, Artificial
  Peptide with targeting and/or antimicrobial activity
AYSGELPEPLVRKMSKEQVRSVMGK

SEQ ID NO: 1402 - protein, 25 aa, Artificial
  Peptide with targeting and/or antimicrobial activity
PFETRESFRVPVIGILGGWDYFMHP

SEQ ID NO: 1403 - protein, 28 aa, Artificial
  Peptide with targeting and/or antimicrobial activity
QKANLRIGFTYTSDSNVCNLTFALLGSK

SEQ ID NO: 1404 - protein, 33 aa, Artificial; identical to SEQ ID NO: 790
  Peptide with targeting and/or antimicrobial activity

SEQ ID NO: 1405 - protein, 7 aa, Artificial
  Peptide with targeting and/or antimicrobial activity
WTARARR

SEQ ID NO: 1406 - protein, 22 aa, Artificial
  Peptide with targeting and/or antimicrobial activity
NLKTIEKECPFCNNKMDIKLKD

SEQ ID NO: 1407 - protein, 28 aa, Artificial
  Peptide with targeting and/or antimicrobial activity
KFQGEFTNIGQSYIVSASHMSTSLNTGK

SEQ ID NO: 1408 - protein, 15 aa, Artificial
  Peptide with targeting and/or antimicrobial activity
SYIKNLSNQKFLIAF

SEQ ID NO: 1409 - protein, 16 aa, Artificial
  Peptide with targeting and/or antimicrobial activity
DYNHLLNVVQDWVNTN

SEQ ID NO: 1410 - protein, 12 aa, Artificial
  Peptide with targeting and/or antimicrobial activity
FFNQANYFFKEF

SEQ ID NO: 1411 - protein, 35 aa, Artificial; identical to SEQ ID NO: 796
  Peptide with targeting and/or antimicrobial activity

SEQ ID NO: 1412 - protein, 12 aa, Artificial
  Peptide with targeting and/or antimicrobial activity
ESVEAIKAKAIK

SEQ ID NO: 1413 - protein, 36 aa, Artificial; identical to SEQ ID NO: 798
  Peptide with targeting and/or antimicrobial activity

SEQ ID NO: 1414 - protein, 10 aa, Artificial
  Peptide with targeting and/or antimicrobial activity
YYQAKLFPLL

SEQ ID NO: 1415 - protein, 27 aa, Artificial
  Peptide with targeting and/or antimicrobial activity
DLLKSLLGQDGAKNDEIIEFIKIIMEK

SEQ ID NO: 1416 - protein, 18 aa, Artificial
  Peptide with targeting and/or antimicrobial activity
IMKNYKYFKLFIVKYALF

SEQ ID NO: 1417 - protein, 26 aa, Artificial
  Peptide with targeting and/or antimicrobial activity
MEISTLKKEKLHVKDELSQYLANYKK

SEQ ID NO: 1418 - protein, 6 aa, Artificial
  Peptide with targeting and/or antimicrobial activity
IVSAIV

SEQ ID NO: 1419 - protein, 19 aa, Artificial
  Peptide with targeting and/or antimicrobial activity
LQNKIYELLYIKERSKLCS

SEQ ID NO: 1420 - protein, 24 aa, Artificial
  Peptide with targeting and/or antimicrobial activity
SKMWDKILTILILILELIRELIKL

SEQ ID NO: 1421 - protein, 19 aa, Artificial
  Peptide with targeting and/or antimicrobial activity
DEIKVSDEEIEKFIKENNL

SEQ ID NO: 1422 - protein, 23 aa, Artificial
  Peptide with targeting and/or antimicrobial activity
MKFMLEVRNKAISAYKEITRTQI

SEQ ID NO: 1423 - protein, 9 aa, Artificial
  Peptide with targeting and/or antimicrobial activity
LFEIFKPKH

SEQ ID NO: 1424 - protein, 41 aa, Artificial; identical to SEQ ID NO: 808
  Peptide with targeting and/or antimicrobial activity

SEQ ID NO: 1425 - protein, 9 aa, Artificial
  Peptide with targeting and/or antimicrobial activity
YRVTVKALE

SEQ ID NO: 1426 - protein, 16 aa, Artificial
  Peptide with targeting and/or antimicrobial activity
LEKEKKEYIEKLFKTK

SEQ ID NO: 1427 - protein, 30 aa, Artificial; identical to SEQ ID NO: 811
  Peptide with targeting and/or antimicrobial activity

SEQ ID NO: 1428 - protein, 7 aa, Artificial
  Peptide with targeting and/or antimicrobial activity
LMEQVEV

SEQ ID NO: 1429 - protein, 11 aa, Artificial
  Peptide with targeting and/or antimicrobial activity
HYRWNTQWWKY

SEQ ID NO: 1430 - protein, 39 aa, Artificial; identical to SEQ ID NO: 1051
  Peptide with targeting and/or antimicrobial activity

SEQ ID NO: 1431 - protein, 19 aa, Artificial
  Peptide with targeting and/or antimicrobial activity
YIESDPRKFDYIFGAIRDH

SEQ ID NO: 1432 - protein, 23 aa, Artificial
  Peptide with targeting and/or antimicrobial activity
TEIKLDNNEYLVLNLDDILGILK

SEQ ID NO: 1433 - protein, 19 aa, Artificial
  Peptide with targeting and/or antimicrobial activity
VFLKLKTSKIDLASIIFYP

SEQ ID NO: 1434 - protein, 35 aa, Artificial; identical to SEQ ID NO: 817
  Peptide with targeting and/or antimicrobial activity

SEQ ID NO: 1435 - protein, 7 aa, Artificial
  Peptide with targeting and/or antimicrobial activity
ADEFAKL

SEQ ID NO: 1436 - protein, 6 aa, Artificial
  Peptide with targeting and/or antimicrobial activity
GLDIYA

SEQ ID NO: 1437 - protein, 25 aa, Artificial
  Peptide with targeting and/or antimicrobial activity
FLNRFIFYIFTVKTKSALIKNLFLD

SEQ ID NO: 1438 - protein, 10 aa, Artificial
  Peptide with targeting and/or antimicrobial activity
IVFVVTKEKK

SEQ ID NO: 1439 - protein, 8 aa, Artificial
  Peptide with targeting and/or antimicrobial activity
PMNAAEPE

SEQ ID NO: 1440 - protein, 29 aa, Artificial
  Peptide with targeting and/or antimicrobial activity
KLNTLNKKDNPSLNDQDKNAVLNLLALAK

SEQ ID NO: 1441 - protein, 18 aa, Artificial
  Peptide with targeting and/or antimicrobial activity
WSRVPGHSDTGWKVWHRW

SEQ ID NO: 1442 - protein, 7 aa, Artificial
  Peptide with targeting and/or antimicrobial activity
PPSSFLV

SEQ ID NO: 1443 - protein, 19 aa, Artificial
  Peptide with targeting and/or antimicrobial activity
TREDVFSVRLINNIVNKQA

SEQ ID NO: 1444 - protein, 21 aa, Artificial
  Peptide with targeting and/or antimicrobial activity
VLFAVYLGALDWLFSWLTQKM

SEQ ID NO: 1445 - protein, 14 aa, Artificial
  Peptide with targeting and/or antimicrobial activity
VFLLDSYCFVKINL

SEQ ID NO: 1446 - protein, 23 aa, Artificial
  Peptide with targeting and/or antimicrobial activity
SDSTNNARTRKKARDVTTKDIDK

SEQ ID NO: 1447 - protein, 12 aa, Artificial
  Peptide with targeting and/or antimicrobial activity
KYDFDDFEPEEA

SEQ ID NO: 1448 - protein, 13 aa, Artificial
  Peptide with targeting and/or antimicrobial activity
INDLLSYFTLHEK

SEQ ID NO: 1449 - protein, 12 aa, Artificial
  Peptide with targeting and/or antimicrobial activity
GLAAIATVFALY

SEQ ID NO: 1450 - protein, 9 aa, Artificial
  Peptide with targeting and/or antimicrobial activity
IPATPIIHS

SEQ ID NO: 1451 - protein, 18 aa, Artificial
  Peptide with targeting and/or antimicrobial activity
LIIYFSKTGNTARATRQI

SEQ ID NO: 1452 - protein, 24 aa, Artificial
  Peptide with targeting and/or antimicrobial activity
TTIQGVASLEKHGFRYTIIYPTRI

SEQ ID NO: 1453 - protein, 30 aa, Artificial; identical to SEQ ID NO: 834
  Peptide with targeting and/or antimicrobial activity

SEQ ID NO: 1454 - protein, 30 aa, Artificial; identical to SEQ ID NO: 835
  Peptide with targeting and/or antimicrobial activity

SEQ ID NO: 1455 - protein, 5 aa, Artificial
  Peptide with targeting and/or antimicrobial activity
LVRLA

SEQ ID NO: 1456 - protein, 26 aa, Artificial
  Peptide with targeting and/or antimicrobial activity
SRIKQDARSVRKYDRIGIFFYSFKSA

SEQ ID NO: 1457 - protein, 6 aa, Artificial
  Peptide with targeting and/or antimicrobial activity
TFILPK

SEQ ID NO: 1458 - protein, 17 aa, Artificial
  Peptide with targeting and/or antimicrobial activity
QATQIKSWIDRLLVSED

SEQ ID NO: 1459 - protein, 8 aa, Artificial
  Peptide with targeting and/or antimicrobial activity
MGDINRNF

SEQ ID NO: 1460 - protein, 27 aa, Artificial
  Peptide with targeting and/or antimicrobial activity
FTTPMIGIPAGLLGGSYYLKRREEKGK

SEQ ID NO: 1461 - protein, 5 aa, Artificial
  Peptide with targeting and/or antimicrobial activity
VRCRL

SEQ ID NO: 1462 - protein, 14 aa, Artificial
  Peptide with targeting and/or antimicrobial activity
TSGLIIGENGLNGL

SEQ ID NO: 1463 - protein, 7 aa, Artificial
  Peptide with targeting and/or antimicrobial activity
SNSVQQG

SEQ ID NO: 1464 - protein, 10 aa, Artificial
  Peptide with targeting and/or antimicrobial activity
APASPGRRPG

SEQ ID NO: 1465 - protein, 14 aa, Artificial
  Peptide with targeting and/or antimicrobial activity
GTFLGQKCAAATAS

SEQ ID NO: 1466 - protein, 23 aa, Artificial
  Peptide with targeting and/or antimicrobial activity
CPRYPFVDVGPAGPWRARWRVGS

SEQ ID NO: 1467 - protein, 11 aa, Artificial
  Peptide with targeting and/or antimicrobial activity
PRWPTGAGRHR

SEQ ID NO: 1468 - protein, 18 aa, Artificial
  Peptide with targeting and/or antimicrobial activity
FLAPARPDLQAQRQALAQ

SEQ ID NO: 1469 - protein, 16 aa, Artificial
  Peptide with targeting and/or antimicrobial activity
QSVHPLPAETPVADVI

SEQ ID NO: 1470 - protein, 9 aa, Artificial
  Peptide with targeting and/or antimicrobial activity
LSGRLAGRR

SEQ ID NO: 1471 - protein, 17 aa, Artificial
  Peptide with targeting and/or antimicrobial activity
DAPCFDDQFGDLKCQMC

SEQ ID NO: 1472 - protein, 14 aa, Artificial
  Peptide with targeting and/or antimicrobial activity
RGMFVPFHDVDCVQ

SEQ ID NO: 1473 - protein, 25 aa, Artificial
  Peptide with targeting and/or antimicrobial activity
YVANYTITQFGRDFDDRLAVAIHFA

SEQ ID NO: 1474 - protein, 21 aa, Artificial
  Peptide with targeting and/or antimicrobial activity
PTTPPPTTPPEIPTGGTVIST

SEQ ID NO: 1475 - protein, 5 aa, Artificial
  Peptide with targeting and/or antimicrobial activity
TVIST

SEQ ID NO: 1476 - protein, 16 aa, Artificial
  Peptide with targeting and/or antimicrobial activity
TDPQATAAPRRRTSPR

SEQ ID NO: 1477 - protein, 23 aa, Artificial
  Peptide with targeting and/or antimicrobial activity
PDEDIRRRAILPPAGPCRPMSPE

SEQ ID NO: 1478 - protein, 21 aa, Artificial
  Peptide with targeting and/or antimicrobial activity
GKQSRAHGPVASRREFRRKSG

SEQ ID NO: 1479 - protein, 8 aa, Artificial
  Peptide with targeting and/or antimicrobial activity
ATLIPRKA

SEQ ID NO: 1480 - protein, 14 aa, Artificial
  Peptide with targeting and/or antimicrobial activity
DQLCVEYPARVSTG

SEQ ID NO: 1481 - protein, 15 aa, Artificial
  Peptide with targeting and/or antimicrobial activity
VLRVATAVGEVPTGL

SEQ ID NO: 1482 - protein, 8 aa, Artificial
  Peptide with targeting and/or antimicrobial activity
PNRRSRPR

SEQ ID NO: 1483 - protein, 24 aa, Artificial
  Peptide with targeting and/or antimicrobial activity
PAHQRLRIDQRLVADRDMVQDYES

SEQ ID NO: 1484 - protein, 24 aa, Artificial
  Peptide with targeting and/or antimicrobial activity
TNAESMALAFRGRVHMSVNIAGLT

SEQ ID NO: 1485 - protein, 11 aa, Artificial
  Peptide with targeting and/or antimicrobial activity
TVIVAPMHSGV

SEQ ID NO: 1486 - protein, 30 aa, Artificial; identical to SEQ ID NO: 1050
  Peptide with targeting and/or antimicrobial activity

SEQ ID NO: 1487 - protein, 24 aa, Artificial
  Peptide with targeting and/or antimicrobial activity
EIIPISPTRRCEMHTMSSAEYRGL

SEQ ID NO: 1488 - protein, 8 aa, Artificial
  Peptide with targeting and/or antimicrobial activity
TCRGAGMH

SEQ ID NO: 1489 - protein, 9 aa, Artificial
  Peptide with targeting and/or antimicrobial activity
ADPHPTTGI

SEQ ID NO: 1490 - protein, 23 aa, Artificial
  Peptide with targeting and/or antimicrobial activity
TALTTVGVSGARLITYCVGVEDI

SEQ ID NO: 1491 - protein, 12 aa, Artificial
  Peptide with targeting and/or antimicrobial activity
RRGKSEQGLSRR

SEQ ID NO: 1492 - protein, 5 aa, Artificial
  Peptide with targeting and/or antimicrobial activity
LWPVA

SEQ ID NO: 1493 - protein, 17 aa, Artificial
  Peptide with targeting and/or antimicrobial activity
RKLSLASGFALWRRSLV

SEQ ID NO: 1494 - protein, 8 aa, Artificial
  Peptide with targeting and/or antimicrobial activity
PTLWLACL

SEQ ID NO: 1495 - protein, 22 aa, Artificial
  Peptide with targeting and/or antimicrobial activity
LAVLMGYIGYRGWSGKRHINRQ

SEQ ID NO: 1496 - protein, 20 aa, Artificial
  Peptide with targeting and/or antimicrobial activity
AKRVLSLAVAPHRRQPVQGT

SEQ ID NO: 1497 - protein, 10 aa, Artificial
  Peptide with targeting and/or antimicrobial activity
ARNHAVIPAG

SEQ ID NO: 1498 - protein, 30 aa, Artificial; identical to SEQ ID NO: 889
  Peptide with targeting and/or antimicrobial activity

SEQ ID NO: 1499 - protein, 19 aa, Artificial
  Peptide with targeting and/or antimicrobial activity
HRTVEFGVLGTYLVSGGSL

SEQ ID NO: 1500 - protein, 21 aa, Artificial
  Peptide with targeting and/or antimicrobial activity
GVAREDPLEPDPLAPIIDDSR

SEQ ID NO: 1501 - protein, 5 aa, Artificial
  Peptide with targeting and/or antimicrobial activity
PDPAR

SEQ ID NO: 1502 - protein, 15 aa, Artificial
  Peptide with targeting and/or antimicrobial activity
DLIRPLYSMSAPSVA

SEQ ID NO: 1503 - protein, 19 aa, Artificial
  Peptide with targeting and/or antimicrobial activity
ALSVMLGNIPLVVPNANQL

SEQ ID NO: 1504 - protein, 14 aa, Artificial
  Peptide with targeting and/or antimicrobial activity
IRSGISAAYARPLR

SEQ ID NO: 1505 - protein, 7 aa, Artificial
  Peptide with targeting and/or antimicrobial activity
RADARAK

SEQ ID NO: 1506 - protein, 15 aa, Artificial
  Peptide with targeting and/or antimicrobial activity
SSGRAGVKCRRPTGR

SEQ ID NO: 1507 - protein, 13 aa, Artificial
  Peptide with targeting and/or antimicrobial activity
GRAGVKCRRPTGR

SEQ ID NO: 1508 - protein, 8 aa, Artificial
  Peptide with targeting and/or antimicrobial activity
LNWPFTGR

SEQ ID NO: 1509 - protein, 9 aa, Artificial
  Peptide with targeting and/or antimicrobial activity
LSGRLAGRR

SEQ ID NO: 1510 - protein, 8 aa, Artificial
  Peptide with targeting and/or antimicrobial activity
APAARAAL

SEQ ID NO: 1511 - protein, 19 aa, Artificial
  Peptide with targeting and/or antimicrobial activity
KSSGSSASASSTAGGSSSK

SEQ ID NO: 1512 - protein, 17 aa, Artificial
  Peptide with targeting and/or antimicrobial activity
KSGATSAASGAKSGASS

SEQ ID NO: 1513 - protein, 20 aa, Artificial
  Peptide with targeting and/or antimicrobial activity
AKREDTVAAQIGANILNLIQ

SEQ ID NO: 1514 - protein, 25 aa, Artificial
  Peptide with targeting and/or antimicrobial activity
LGVGTFVGKVLIKNQQKQKSKKKAQ

SEQ ID NO: 1515 - protein, 38 aa, Artificial; identical to SEQ ID NO: 925
  Peptide with targeting and/or antimicrobial activity

SEQ ID NO: 1516 - protein, 11 aa, Artificial
  Peptide with targeting and/or antimicrobial activity
FLGNSQYFTRK

SEQ ID NO: 1517 - protein, 40 aa, Artificial; identical to SEQ ID NO: 927
  Peptide with targeting and/or antimicrobial activity

SEQ ID NO: 1518 - protein, 33 aa, Artificial; identical to SEQ ID NO: 928
  Peptide with targeting and/or antimicrobial activity

SEQ ID NO: 1519 - protein, 30 aa, Artificial; identical to SEQ ID NO: 931
  Peptide with targeting and/or antimicrobial activity

SEQ ID NO: 1520 - protein, 7 aa, Artificial
  Peptide with targeting and/or antimicrobial activity
DALLRLA

SEQ ID NO: 1521 - protein, 11 aa, Artificial
  Peptide with targeting and/or antimicrobial activity
PQAISSVQQNA

SEQ ID NO: 1522 - protein, 21 aa, Artificial
  Peptide with targeting and/or antimicrobial activity
DHITLDDYEIHDGFNFELYYG

SEQ ID NO: 1523 - protein, 32 aa, Artificial; identical to SEQ ID NO: 936
  Peptide with targeting and/or antimicrobial activity

SEQ ID NO: 1524 - protein, 19 aa, Artificial
  Peptide with targeting and/or antimicrobial activity
PAPAPSAPAPAPEQPEQPA

SEQ ID NO: 1525 - protein, 43 aa, Artificial; identical to SEQ ID NO: 938
  Peptide with targeting and/or antimicrobial activity

SEQ ID NO: 1526 - protein, 9 aa, Artificial
  Peptide with targeting and/or antimicrobial activity
GYFEPGKRD

SEQ ID NO: 1527 - protein, 28 aa, Artificial
  Peptide with targeting and/or antimicrobial activity
GVGIGFIMMGVVGYAVKLVHIPIRYLIV

SEQ ID NO: 1528 - protein, 29 aa, Artificial
  Peptide with targeting and/or antimicrobial activity
VSILLYLSATIILPNVLRLLVARAIIVRV

SEQ ID NO: 1529 - protein, 7 aa, Artificial
  Peptide with targeting and/or antimicrobial activity
SRFRNGV

SEQ ID NO: 1530 - protein, 25 aa, Artificial
  Peptide with targeting and/or antimicrobial activity
YNLSIYIYFLHTITIAGLITLPFII

SEQ ID NO: 1531 - protein, 27 aa, Artificial
  Peptide with targeting and/or antimicrobial activity
YFWWYWVQDCIPYKNNEVWLELSNNMK

SEQ ID NO: 1532 - protein, 36 aa, Artificial; identical to SEQ ID NO: 980
  Peptide with targeting and/or antimicrobial activity

SEQ ID NO: 1533 - protein, 33 aa, Artificial; identical to SEQ ID NO: 981
  Peptide with targeting and/or antimicrobial activity

SEQ ID NO: 1534 - protein, 24 aa, Artificial
  Peptide with targeting and/or antimicrobial activity
PLARATEVVATLFIICSLLLYLTR

SEQ ID NO: 1535 - protein, 24 aa, Artificial
  Peptide with targeting and/or antimicrobial activity
DEEALEMGANLYAQFAIDFLNSKK

SEQ ID NO: 1536 - protein, 40 aa, Artificial; identical to SEQ ID NO: 985
  Peptide with targeting and/or antimicrobial activity

SEQ ID NO: 1537 - protein, 28 aa, Artificial
  Peptide with targeting and/or antimicrobial activity
NALMLREMQLAKNIKVEVTDVLSNKKYC

SEQ ID NO: 1538 - protein, 7 aa, Artificial
  Peptide with targeting and/or antimicrobial activity
QVIVKIL

SEQ ID NO: 1539 - protein, 41 aa, Artificial; identical to SEQ ID NO: 989
  Peptide with targeting and/or antimicrobial activity

SEQ ID NO: 1540 - protein, 26 aa, Artificial
  Peptide with targeting and/or antimicrobial activity
KALVISVFAIVFSIIFVKFFYWRDKK

SEQ ID NO: 1541 - protein, 24 aa, Artificial
  Peptide with targeting and/or antimicrobial activity
FFSVIFLFGLNYLICNSPLFNILR

SEQ ID NO: 1542 - protein, 25 aa, Artificial
  Peptide with targeting and/or antimicrobial activity
KKFKIFVIINWFYHKYIILNFEENF

SEQ ID NO: 1543 - protein, 30 aa, Artificial; identical to SEQ ID NO: 994
  Peptide with targeting and/or antimicrobial activity

SEQ ID NO: 1544 - protein, 17 aa, Artificial
  Peptide with targeting and/or antimicrobial activity
DIANNILNSVSERLIIA

SEQ ID NO: 1545 - protein, 29 aa, Artificial
  Peptide with targeting and/or antimicrobial activity
MPKRHYYKLEAKALQFGLPFAYSPIQLLK

SEQ ID NO: 1546 - protein, 31 aa, Artificial; identical to SEQ ID NO: 996
  Peptide with targeting and/or antimicrobial activity

SEQ ID NO: 1547 - protein, 35 aa, Artificial; identical to SEQ ID NO: 998
  Peptide with targeting and/or antimicrobial activity

SEQ ID NO: 1548 - protein, 36 aa, Artificial; identical to SEQ ID NO: 999
  Peptide with targeting and/or antimicrobial activity

SEQ ID NO: 1549 - protein, 33 aa, Artificial; identical to SEQ ID NO: 1000
  Peptide with targeting and/or antimicrobial activity

SEQ ID NO: 1550 - protein, 27 aa, Artificial
  Peptide with targeting and/or antimicrobial activity
QWIVAKREIRMHIYCHISVIHVIIFFG

SEQ ID NO: 1551 - protein, 36 aa, Artificial; identical to SEQ ID NO: 1003
  Peptide with targeting and/or antimicrobial activity

SEQ ID NO: 1552 - protein, 22 aa, Artificial
  Peptide with targeting and/or antimicrobial activity
LILSYQASVYPLFAYLCQQKDY

SEQ ID NO: 1553 - protein, 25 aa, Artificial
  Peptide with targeting and/or antimicrobial activity
QRMYWFKRGFETGDFSAGDTFAELK

SEQ ID NO: 1554 - protein, 27 aa, Artificial
  Peptide with targeting and/or antimicrobial activity
LLASHPERLSLGVFFVYRVLHLLLENT

SEQ ID NO: 1555 - protein, 28 aa, Artificial
  Peptide with targeting and/or antimicrobial activity
DFPPLSFFRRRFHAYTAPIDNFFGANPF

SEQ ID NO: 1556 - protein, 10 aa, Artificial
  Peptide with targeting and/or antimicrobial activity
VVFGGGDRLV

SEQ ID NO: 1557 - protein, 7 aa, Artificial
  Peptide with targeting and/or antimicrobial activity
YGKESDP

SEQ ID NO: 1558 - protein, 40 aa, Artificial; identical to SEQ ID NO: 1011
  Peptide with targeting and/or antimicrobial activity

SEQ ID NO: 1559 - protein, 33 aa, Artificial; identical to SEQ ID NO: 1012
  Peptide with targeting and/or antimicrobial activity

SEQ ID NO: 1560 - protein, 41 aa, Artificial; identical to SEQ ID NO: 1013
  Peptide with targeting and/or antimicrobial activity

SEQ ID NO: 1561 - protein, 14 aa, Artificial
  Peptide with targeting and/or antimicrobial activity
GGHKQLVIEPLVSQ

SEQ ID NO: 1562 - protein, 30 aa, Artificial; identical to SEQ ID NO: 1017
  Peptide with targeting and/or antimicrobial activity

SEQ ID NO: 1563 - protein, 30 aa, Artificial; identical to SEQ ID NO: 1019
  Peptide with targeting and/or antimicrobial activity

SEQ ID NO: 1564 - protein, 29 aa, Artificial
  Peptide with targeting and/or antimicrobial activity
HPFLTGTGCPLFLIFRLFFVKAYFSFTVF

SEQ ID NO: 1565 - protein, 15 aa, Artificial
  Peptide with targeting and/or antimicrobial activity
IIIILPKIYLVCKTV

SEQ ID NO: 1566 - protein, 32 aa, Artificial; identical to SEQ ID NO: 1021
  Peptide with targeting and/or antimicrobial activity

SEQ ID NO: 1567 - protein, 24 aa, Artificial
  Peptide with targeting and/or antimicrobial activity
LSLATFAKIFMTRSNWSLKRFNRL

SEQ ID NO: 1568 - protein, 56 aa, Artificial; identical to SEQ ID NO: 138
  Peptide with targeting and/or antimicrobial activity

SEQ ID NO: 1569 - protein, 24 aa, Artificial
  Peptide with targeting and/or antimicrobial activity
FESLLPQATKKIVNNKGSKINKIF

SEQ ID NO: 1570 - protein, 25 aa, Artificial
  Peptide with targeting and/or antimicrobial activity
KKFKIFVIINWFYHKYIILNFEENF

SEQ ID NO: 1571 - protein, 21 aa, Artificial
  Peptide with targeting and/or antimicrobial activity
YIQFHLNQQPRPKVKKIKIFL

SEQ ID NO: 1572 - protein, 41 aa, Artificial; identical to SEQ ID NO: 1013
  Peptide with targeting and/or antimicrobial activity

SEQ ID NO: 1573 - protein, 44 aa, Artificial; identical to SEQ ID NO: 219
  Peptide with targeting and/or antimicrobial activity

SEQ ID NO: 1574 - protein, 30 aa, Artificial; identical to SEQ ID NO: 671
  Peptide with targeting and/or antimicrobial activity

SEQ ID NO: 1575 - protein, 20 aa, Artificial
  Peptide with targeting and/or antimicrobial activity
NYRLVNAIFSKIFKKKFIKF

SEQ ID NO: 1576 - protein, 40 aa, Artificial
  Peptide with targeting and/or antimicrobial activity
MAWKFIKLDKVVSQKECNNFLEKEENKKLLKLLRIQKNMR

SEQ ID NO: 1577 - protein, 37 aa, Artificial
  Peptide with targeting and/or antimicrobial activity
MDIWKFIKSFNTVNTYLLLSCVLLIILVLYFYVINPA

SEQ ID NO: 1578 - protein, 22 aa, Artificial
  Peptide with targeting and/or antimicrobial activity
LVLRICTDLFTFIKWTIKQRKS

SEQ ID NO: 1579 - protein, 21 aa, Artificial
  Peptide with targeting and/or antimicrobial activity
DLCGQEFIKFKTCVTNQLAKK

SEQ ID NO: 1580 - protein, 27 aa, Artificial
  Peptide with targeting and/or antimicrobial activity
DLLKSLLGQDGAKNDEIIEFIKIIMEK

SEQ ID NO: 1581 - protein, 19 aa, Artificial
  Peptide with targeting and/or antimicrobial activity
DEIKVSDEEIEKFIKENNL

SEQ ID NO: 1582 - protein, 37 aa, Artificial
  Peptide with targeting and/or antimicrobial activity
LICEVVKPEEDFIKVKLNEDNVTAKISREFIAKKIDA

SEQ ID NO: 1583 - protein, 35 aa, Artificial; identical to SEQ ID NO: 141
  Peptide with targeting and/or antimicrobial activity

SEQ ID NO: 1584 - protein, 20 aa, Artificial
  Peptide with targeting and/or antimicrobial activity
NYRLVNAIFSKIFKKKFIKF

SEQ ID NO: 1585 - protein, 31 aa, Artificial; identical to SEQ ID NO: 269
  Peptide with targeting and/or antimicrobial activity

SEQ ID NO: 1586 - protein, 30 aa, Artificial; identical to SEQ ID NO: 1019
  Peptide with targeting and/or antimicrobial activity

SEQ ID NO: 1587 - protein, 21 aa, Artificial
  Peptide with targeting and/or antimicrobial activity
MGIIAGIIKFIKGLIEKFTGK

SEQ ID NO: 1588 - protein, 23 aa, Artificial
  Peptide with targeting and/or antimicrobial activity
LIQKGLNQTFIVVIRLNNFIKKS

SEQ ID NO: 1589 - protein, 30 aa, Artificial; identical to SEQ ID NO: 363
  Peptide with targeting and/or antimicrobial activity

SEQ ID NO: 1590 - protein, 40 aa, Artificial; identical to SEQ ID NO: 522
  Peptide with targeting and/or antimicrobial activity

SEQ ID NO: 1591 - protein, 25 aa, Artificial
  Peptide with targeting and/or antimicrobial activity
LNFRAENKILEKIHISLIDTVEGSA

SEQ ID NO: 1592 - protein, 18 aa, Artificial
  Peptide with targeting and/or antimicrobial activity
KTPNDKIHKTIIIKHIIL

SEQ ID NO: 1593 - protein, 6 aa, Artificial
  Peptide with targeting and/or antimicrobial activity
HIKETR

SEQ ID NO: 1594 - protein, 41 aa, Artificial; identical to SEQ ID NO: 567
  Peptide with targeting and/or antimicrobial activity

SEQ ID NO: 1595 - protein, 12 aa, Artificial
  Peptide with targeting and/or antimicrobial activity
HKNKLNIPHIKS

SEQ ID NO: 1596 - protein, 41 aa, Artificial
  Peptide with targeting and/or antimicrobial activity
MTLTIKIKHRSKIVPLNLISLVYAFFTYNFVANRIMFLTND

SEQ ID NO: 1597 - protein, 11 aa, Artificial
  Peptide with targeting and/or antimicrobial activity
PEIIKIVSGLL

SEQ ID NO: 1598 - protein, 23 aa, Artificial
  Peptide with targeting and/or antimicrobial activity
MLTSRKKRLKKIVEEQNKKDESI

SEQ ID NO: 1599 - protein, 24 aa, Artificial
  Peptide with targeting and/or antimicrobial activity
FESLLPQATKKIVNNKGSKINKIF

SEQ ID NO: 1600 - protein, 16 aa, Artificial
  Peptide with targeting and/or antimicrobial activity
TEQAKKIVDILNNWLE

SEQ ID NO: 1601 - protein, 25 aa, Artificial
  Peptide with targeting and/or antimicrobial activity
FEDIEQIIKYHLIDGKIVAPLLLDR

SEQ ID NO: 1602 - protein, 23 aa, Artificial
  Peptide with targeting and/or antimicrobial activity
KRGSKIVIAIAVVLIVLAGVWVW

SEQ ID NO: 1603 - protein, 25 aa, Artificial
  Peptide with targeting and/or antimicrobial activity
ALDCSEQSVILWYETILDKIVGVIK

SEQ ID NO: 1604 - protein, 38 aa, Artificial; identical to SEQ ID NO: 527
  Peptide with targeting and/or antimicrobial activity

SEQ ID NO: 1605 - protein, 38 aa, Artificial; identical to SEQ ID NO: 501
  Peptide with targeting and/or antimicrobial activity

SEQ ID NO: 1606 - protein, 33 aa, Artificial; identical to SEQ ID NO: 790
  Peptide with targeting and/or antimicrobial activity

SEQ ID NO: 1607 - protein, 19 aa, Artificial
  Peptide with targeting and/or antimicrobial activity
ALCSVIKAIELGIINVHLQ

SEQ ID NO: 1608 - protein, 24 aa, Artificial
  Peptide with targeting and/or antimicrobial activity
NGDKKAKEELDKWDEVIKELNIQF

SEQ ID NO: 1609 - protein, 32 aa, Artificial; identical to SEQ ID NO: 38
  Peptide with targeting and/or antimicrobial activity

SEQ ID NO: 1610 - protein, 15 aa, Artificial
  Peptide with targeting and/or antimicrobial activity
VIKISVPGQVQMLIP

SEQ ID NO: 1611 - protein, 32 aa, Artificial; identical to SEQ ID NO: 750
  Peptide with targeting and/or antimicrobial activity

SEQ ID NO: 1612 - protein, 20 aa, Artificial
  Peptide with targeting and/or antimicrobial activity
AIEGVIKKGACFKLLRHEMF

SEQ ID NO: 1613 - protein, 18 aa, Artificial
  Peptide with targeting and/or antimicrobial activity
KRKHENVIVAEEMRVIKN

SEQ ID NO: 1614 - protein, 21 aa, Artificial
  Peptide with targeting and/or antimicrobial activity
MGIIAGIIKVIKSLIEQFTGK

SEQ ID NO: 1615 - protein, 30 aa, Artificial; identical to SEQ ID NO: 393
  Peptide with targeting and/or antimicrobial activity

SEQ ID NO: 1616 - protein, 25 aa, Artificial
  Peptide with targeting and/or antimicrobial activity
ALDCSEQSVILWYETILDKIVGVIK

SEQ ID NO: 1617 - protein, 28 aa, Artificial
  Peptide with targeting and/or antimicrobial activity
WSESQPPTATPRPHAEVARAGLVTPPTL

SEQ ID NO: 1618 - protein, 30 aa, Artificial; identical to SEQ ID NO: 931
  Peptide with targeting and/or antimicrobial activity

SEQ ID NO: 1619 - protein, 30 aa, Artificial; identical to SEQ ID NO: 1050
  Peptide with targeting and/or antimicrobial activity

SEQ ID NO: 1620 - protein, 18 aa, Artificial
  Peptide with targeting and/or antimicrobial activity
VMFVLTRGRSPRPMIPAY

SEQ ID NO: 1621 - protein, 22 aa, Artificial
  Peptide with targeting and/or antimicrobial activity
LSPRPIIVSRRSRADNNNDWSR

SEQ ID NO: 1622 - protein, 28 aa, Artificial
  Peptide with targeting and/or antimicrobial activity
VLPFPAIPLSRRRACVAAPRPRSRQRAS

SEQ ID NO: 1623 - protein, 21 aa, Artificial
  Peptide with targeting and/or antimicrobial activity
YIQFHLNQQPRPKVKKIKIFL

SEQ ID NO: 1624 - protein, 13 aa, Artificial
  Peptide with targeting and/or antimicrobial activity
RRLASRRSLVVST

SEQ ID NO: 1625 - protein, 35 aa, Artificial
  Peptide with targeting and/or antimicrobial activity
RLLGLYGENSAAGFIASVIGAVIILFIYNLIARKS

SEQ ID NO: 1626 - protein, 28 aa, Artificial
  Peptide with targeting and/or antimicrobial activity
GHLRVCWILWLQSANPLSFRHHYLAVMW

SEQ ID NO: 1627 - protein, 37 aa, Artificial; identical to SEQ ID NO: 1577
  Peptide with targeting and/or antimicrobial activity

SEQ ID NO: 1628 - protein, 39 aa, Artificial
  Peptide with targeting and/or antimicrobial activity
MIIQNKKIEKIYKYQTKEIFLNKTSLRAGFVFRMVRVLI

SEQ ID NO: 1629 - protein, 40 aa, Artificial
  Peptide with targeting and/or antimicrobial activity
MLIDWQEPDIEKSFCAAFLKISVSVLVYRTPLGYGNQLRE

SEQ ID NO: 1630 - protein, 10 aa, Artificial
  Peptide with targeting and/or antimicrobial activity
FFDGEVGCGC

SEQ ID NO: 1631 - protein, 14 aa, Artificial
  Peptide with targeting and/or antimicrobial activity
ILEQNIEEVFFIQS

SEQ ID NO: 1632 - protein, 34 aa, Artificial
  Peptide with targeting and/or antimicrobial activity
MDKIRIWNNFHISNEYIKQRYGIISIPLFYVYLF

SEQ ID NO: 1633 - protein, 39 aa, Artificial
  Peptide with targeting and/or antimicrobial activity
FAKKNPCRMRVPNTGTWYLVVNQDGNSGIVNFSINTIQN

SEQ ID NO: 1634 - protein, 31 aa, Artificial
  Peptide with targeting and/or antimicrobial activity
MLVFQMRYQMRYVDKTSTVLKQTKNSDYADK

SEQ ID NO: 1635 - protein, 36 aa, Artificial
  Peptide with targeting and/or antimicrobial activity
MLMNFEVYQQRILIIYNKCYHLKAVGKNLQLFIIVD

SEQ ID NO: 1636 - protein, 35 aa, Artificial; identical to SEQ ID NO: 1222
  Peptide with targeting and/or antimicrobial activity

SEQ ID NO: 1637 - protein, 13 aa, Artificial
  Peptide with targeting and/or antimicrobial activity
DDKNEGKIAQGEY

SEQ ID NO: 1638 - protein, 7 aa, Artificial
  Peptide with targeting and/or antimicrobial activity
EASVYRE

SEQ ID NO: 1639 - protein, 30 aa, Artificial
  Peptide with targeting and/or antimicrobial activity
MVKHNFDVTDKTGKISSKHCFEITDKTDVV

SEQ ID NO: 1640 - protein, 20 aa, Artificial
  Peptide with targeting and/or antimicrobial activity
DRPSQTTHHTLSSSRITGPS

SEQ ID NO: 1641 - protein, 19 aa, Artificial
  Peptide with targeting and/or antimicrobial activity
EALLPPDPPDEDSQRIIPQ

SEQ ID NO: 1642 - protein, 20 aa, Artificial
  Peptide with targeting and/or antimicrobial activity
DRPSQTTHHTLSSSRITGPS

SEQ ID NO: 1643 - protein, 14 aa, Artificial
  Peptide with targeting and/or antimicrobial activity
LEDTKALFPCFVPI

SEQ ID NO: 1644 - protein, 17 aa, Artificial
  Peptide with targeting and/or antimicrobial activity
KKYSSFKSMIDDLEYDA

SEQ ID NO: 1645 - protein, 12 aa, Artificial
  Peptide with targeting and/or antimicrobial activity
FKSMIDDLEYDA

SEQ ID NO: 1646 - protein, 16 aa, Artificial
  Peptide with targeting and/or antimicrobial activity
TEQAKKIVDILNNWLE

SEQ ID NO: 1647 - protein, 17 aa, Artificial
  Peptide with targeting and/or antimicrobial activity
STSPSVTSVYAEALGLK

SEQ ID NO: 1648 - protein, 17 aa, Artificial
  Peptide with targeting and/or antimicrobial activity
VGAMAIFLNVVAMLAGV

SEQ ID NO: 1649 - protein, 17 aa, Artificial
  Peptide with targeting and/or antimicrobial activity
ARTIQNNGCLIHNSRYP

SEQ ID NO: 1650 - protein, 19 aa, Artificial
  Peptide with targeting and/or antimicrobial activity
CDDLYALEAQGTLNELLKK

SEQ ID NO: 1651 - protein, 10 aa, Artificial
  Peptide with targeting and/or antimicrobial activity
TPEPVVIVKP

SEQ ID NO: 1652 - protein, 25 aa, Artificial
  Peptide with targeting and/or antimicrobial activity
FEDIEQIIKYHLIDGKIVAPLLLDR

SEQ ID NO: 1653 - protein, 23 aa, Artificial
  Peptide with targeting and/or antimicrobial activity
SDIIAEMFQQGELEPMLRDAVAA

SEQ ID NO: 1654 - protein, 15 aa, Artificial
  Peptide with targeting and/or antimicrobial activity
KGSASGSASGSGSAK

SEQ ID NO: 1655 - protein, 14 aa, Artificial
  Peptide with targeting and/or antimicrobial activity
KSGASSVASAAKSG

SEQ ID NO: 1656 - protein, 10 aa, Artificial
  Peptide with targeting and/or antimicrobial activity
AAATTATTAK

SEQ ID NO: 1657 - protein, 20 aa, Artificial
  Peptide with targeting and/or antimicrobial activity
TKGTTTGTAKTTGVTTGTAK

SEQ ID NO: 1658 - protein, 13 aa, Artificial
  Peptide with targeting and/or antimicrobial activity
GSRGGAKRGGARG

SEQ ID NO: 1659 - protein, 28 aa, Artificial
  Peptide with targeting and/or antimicrobial activity
WSESQPPTATPRPHAEVARAGLVTPPTL

SEQ ID NO: 1660 - protein, 26 aa, Artificial
  Peptide with targeting and/or antimicrobial activity
QPIGFPTDSVHGTDLVHRLRGTTSSR

SEQ ID NO: 1661 - protein, 37 aa, Artificial
  Peptide with targeting and/or antimicrobial activity
LENLDIEGLTEMKEHIEDLIAEKSAAESIEEVIVEAE

SEQ ID NO: 1662 - protein, 38 aa, Artificial
  Peptide with targeting and/or antimicrobial activity
AYSLTFQNPNDNLTDEEVAKYMEKITKALTEKIGAEVR

SEQ ID NO: 1663 - protein, 28 aa, Artificial
  Peptide with targeting and/or antimicrobial activity
PLTRETFAERGIRKARVARTFSEEEPPF

SEQ ID NO: 1664 - protein, 16 aa, Artificial
  Peptide with targeting and/or antimicrobial activity
RGLRRLGRRGLRRLGR

SEQ ID NO: 1665 - protein, 13 aa, Artificial
  Peptide with targeting and/or antimicrobial activity
KPVLPVLPVLPVL

SEQ ID NO: 1666 - protein, 16 aa, Artificial
  Peptide with targeting and/or antimicrobial activity
VLRIIRIAVLRIIRIA

SEQ ID NO: 1667 - protein, 15 aa, Artificial
  Peptide with targeting and/or antimicrobial activity
LPETGGSGGSLPETG

SEQ ID NO: 1668 - protein, 11 aa, Artificial
  Peptide with targeting and/or antimicrobial activity
RAHIRRAHIRR

SEQ ID NO: 1669 - protein, 14 aa, Artificial
  Peptide with targeting and/or antimicrobial activity
DEDEDDEEDDDEEE

SEQ ID NO: 1670 - protein, 15 aa, Artificial
  Peptide with targeting and/or antimicrobial activity
STMCGSTMCGSTMCG

SEQ ID NO: 1671 - protein, 12 aa, Artificial
  Peptide with targeting and/or antimicrobial activity
VRLPLWLPSLNE

SEQ ID NO: 1672 - protein, 12 aa, Artificial
  Peptide with targeting and/or antimicrobial activity
ANYFLPPVLSSS

SEQ ID NO: 1673 - protein, 12 aa, Artificial
  Peptide with targeting and/or antimicrobial activity
SHPWNAQRELSV

SEQ ID NO: 1674 - protein, 12 aa, Artificial
  Peptide with targeting and/or antimicrobial activity
SVSVGMRPMPRP

SEQ ID NO: 1675 - protein, 12 aa, Artificial
  Peptide with targeting and/or antimicrobial activity
WTPLHPSTNRPP

SEQ ID NO: 1676 - protein, 12 aa, Artificial
  Peptide with targeting and/or antimicrobial activity
SVSVGMKPSPRP

SEQ ID NO: 1677 - protein, 12 aa, Artificial
  Peptide with targeting and/or antimicrobial activity
SVSVGMKPSPRP

SEQ ID NO: 1678 - protein, 12 aa, Artificial
  Peptide with targeting and/or antimicrobial activity
SVPVGPYNESQP

SEQ ID NO: 1679 - protein, 12 aa, Artificial
  Peptide with targeting and/or antimicrobial activity
WAPPLFRSSLFY

SEQ ID NO: 1680 - protein, 12 aa, Artificial
  Peptide with targeting and/or antimicrobial activity
  misc_feature (5)..(5): Xaa can be any naturally occurring amino acid
  misc_feature (7)..(7): Xaa can be any naturally occurring amino acid
WAPPXPXSSLFY

SEQ ID NO: 1681 - protein, 12 aa, Artificial
  Peptide with targeting and/or antimicrobial activity
HHGWTHHWPPPP

SEQ ID NO: 1682 - protein, 12 aa, Artificial
  Peptide with targeting and/or antimicrobial activity
SYYSLPPIFHIP

SEQ ID NO: 1683 - protein, 13 aa, Artificial
  Peptide with targeting and/or antimicrobial activity
HFQENPLSRGGEL

SEQ ID NO: 1684 - protein, 12 aa, Artificial
  Peptide with targeting and/or antimicrobial activity
FSYSPTRAPLNM

SEQ ID NO: 1685 - protein, 12 aa, Artificial
  Peptide with targeting and/or antimicrobial activity
  misc_feature (2)..(2): Xaa can be any naturally occurring amino acid
  misc_feature (4)..(5): Xaa can be any naturally occurring amino acid
  misc_feature (8)..(8): Xaa can be any naturally occurring amino acid
  misc_feature (10)..(12): Xaa can be any naturally occurring amino acid
SXPXXMKXSXXX

SEQ ID NO: 1686 - protein, 12 aa, Artificial
  Peptide with targeting and/or antimicrobial activity
VSRHQSWHPHDL

SEQ ID NO: 1687 - protein, 12 aa, Artificial
  Peptide with targeting and/or antimicrobial activity
  misc_feature (3)..(3): Xaa can be any naturally occurring amino acid
  misc_feature (10)..(10): Xaa can be any naturally occurring amino acid
DYXYRGLPRXET

SEQ ID NO: 1688 - protein, 12 aa, Artificial
  Peptide with targeting and/or antimicrobial activity
SVSVGMKPSPRP

SEQ ID NO: 1689 - protein, 12 aa, Artificial
  Peptide with targeting and/or antimicrobial activity
  misc_feature (1)..(2): Xaa can be any naturally occurring amino acid
  misc_feature (5)..(12): Xaa can be any naturally occurring amino acid
XXHEXXXXXXXX

SEQ ID NO: 1690 - protein, 12 aa, Artificial
  Peptide with targeting and/or antimicrobial activity
KHLQNRSTGYET

SEQ ID NO: 1691 - protein, 12 aa, Artificial
  Peptide with targeting and/or antimicrobial activity
HIHSLSPSKTWP

SEQ ID NO: 1692 - protein, 12 aa, Artificial
  Peptide with targeting and/or antimicrobial activity
TITPTDAEMPFL

SEQ ID NO: 1693 - protein, 12 aa, Artificial
  Peptide with targeting and/or antimicrobial activity
HLLESGVLERGM

SEQ ID NO: 1694 - protein, 12 aa, Artificial
  Peptide with targeting and/or antimicrobial activity
HDRYHIPPLQLH

SEQ ID NO: 1695 - protein, 12 aa, Artificial
  Peptide with targeting and/or antimicrobial activity
VNTLQNVRHMAA

SEQ ID NO: 1696 - protein, 12 aa, Artificial
  Peptide with targeting and/or antimicrobial activity
SNYMKLRAVSPF

SEQ ID NO: 1697 - protein, 12 aa, Artificial
  Peptide with targeting and/or antimicrobial activity
NLQMPYAWRTEF

SEQ ID NO: 1698 - protein, 12 aa, Artificial
  Peptide with targeting and/or antimicrobial activity
QKPLTGPHFSLI

SEQ ID NO: 1699 - protein, 21 aa, Artificial
  Peptide with targeting and/or antimicrobial activity
SGSLSTFFRLFNRSFTQALGK

SEQ ID NO: 1700 - protein, 18 aa, Artificial
  Peptide with targeting and/or antimicrobial activity
LSTFFRLFNRSFTQALGK

SEQ ID NO: 1701 - protein, 16 aa, Artificial
  Peptide with targeting and/or antimicrobial activity
TFFRLFNRSFTQALGK

SEQ ID NO: 1702 - protein, 8 aa, Artificial
  Peptide with targeting and/or antimicrobial activity
TFFRLFNR

SEQ ID NO: 1703 - protein, 12 aa, Artificial
  Peptide with targeting and/or antimicrobial activity
KKHRKHRKHRKH

SEQ ID NO: 1704 - protein, 7 aa, Artificial
  Peptide with targeting and/or antimicrobial activity
LVTLVFV

SEQ ID NO: 1705 - protein, 8 aa, Artificial
  Peptide with targeting and/or antimicrobial activity
YSTCDFIM

SEQ ID NO: 1706 - protein, 9 aa, Artificial
  Peptide with targeting and/or antimicrobial activity
GVNACSSLF

SEQ ID NO: 1707 - protein, 8 aa, Artificial
  Peptide with targeting and/or antimicrobial activity
YINCDFLL

SEQ ID NO: 1708 - protein, 36 aa, Artificial
  Peptide with targeting and/or antimicrobial activity
ITSISLCTPGCKTGALMGCNMRTATCIICSIIIVSK

SEQ ID NO: 1709 - protein, 26 aa, Artificial
  Peptide with targeting and/or antimicrobial activity
KSSAYSLQMGATAIKQVKKLFKKWGW

SEQ ID NO: 1710 - protein, 9 aa, Artificial
  Peptide with targeting and/or antimicrobial activity
WWYNWWQDW

SEQ ID NO: 1711 - protein, 16 aa, Artificial
  Peptide with targeting and/or antimicrobial activity
RQIKIWFWNRRMKWKK

SEQ ID NO: 1712 - protein, 11 aa, Artificial
  Peptide with targeting and/or antimicrobial activity
EHWSYCDLRPG

SEQ ID NO: 1713 - protein, 12 aa, Artificial
  Peptide with targeting and/or antimicrobial activity
KETWWETWWTEW

SEQ ID NO: 1714 - protein, 27 aa, Artificial
  Peptide with targeting and/or antimicrobial activity
MRKEFHNVLSSGQLLADKRPARDYNRK

SEQ ID NO: 1715 - protein, 27 aa, Artificial
  Peptide with targeting and/or antimicrobial activity
LKQKIKHVVKLKVVVKLRSQLVKRKQN

SEQ ID NO: 1716 - protein, 15 aa, Artificial
  Peptide with targeting and/or antimicrobial activity
STMMSRSHKTRSHHV

SEQ ID NO: 1717 - protein, 16 aa, Artificial
  Peptide with targeting and/or antimicrobial activity
GAHWQFNALTVRGGGS

SEQ ID NO: 1718 - protein, 15 aa, Artificial
  Peptide with targeting and/or antimicrobial activity
KQRTSIRATEGCLPS

SEQ ID NO: 1719 - protein, 10 aa, Artificial
  Peptide with targeting and/or antimicrobial activity
QEKIRVRLSA

SEQ ID NO: 1720 - protein, 20 aa, Artificial
  Peptide with targeting and/or antimicrobial activity
QLKTADLPAGRDETTSFVLV

SEQ ID NO: 1721 - protein, 34 aa, Artificial
  Peptide with targeting and/or antimicrobial activity
GFKLKGMARISCLPNGQWSNFPPKCIRECAMVSS

SEQ ID NO: 1722 - protein, 34 aa, Artificial
  Peptide with targeting and/or antimicrobial activity
HAEHKVKIGVEQKYGQFPQGTEVTYTCSGNYFLM

SEQ ID NO: 1723 - protein, 20 aa, Artificial
  Peptide with targeting and/or antimicrobial activity
AMDMYSIEDRYFGGYAPEVG

SEQ ID NO: 1724 - protein, 28 aa, Artificial
  Peptide with targeting and/or antimicrobial activity
ASQQGTAALQKELKRIKPDYSDSFKIKH

SEQ ID NO: 1725 - protein, 35 aa, Artificial
  Peptide with targeting and/or antimicrobial activity
SSQISMVPNVGLKFSISNANIKISGKWKAQKRFLK

SEQ ID NO: 1726 - protein, 28 aa, Artificial
  Peptide with targeting and/or antimicrobial activity
VHVHISKSKVGWLIQLFHKKIESALRNK

SEQ ID NO: 1727 - protein, 29 aa, Artificial
  Peptide with targeting and/or antimicrobial activity
AAQEGLLALQSELLRITLPDFTGDLRIPH

SEQ ID NO: 1728 - protein, 35 aa, Artificial
  Peptide with targeting and/or antimicrobial activity
HSALRPVPGQGLSLSISDSSIRVQGRWKVRKSFFK

SEQ ID NO: 1729 - protein, 27 aa, Artificial
  Peptide with targeting and/or antimicrobial activity
VEVDMSGDLGWLLNLFHNQIESKFQKV

SEQ ID NO: 1730 - protein, 8 aa, Artificial
  Peptide with targeting and/or antimicrobial activity
ATYPLPIR

SEQ ID NO: 1731 - protein, 4 aa, Artificial
  Peptide with targeting and/or antimicrobial activity
NHFL

SEQ ID NO: 1732 - protein, 5 aa, Artificial
  Peptide with targeting and/or antimicrobial activity
NHFLP

SEQ ID NO: 1733 - protein, 7 aa, Artificial
  Peptide with targeting and/or antimicrobial activity
TSQNVRT

SEQ ID NO: 1734 - protein, 7 aa, Artificial
  Peptide with targeting and/or antimicrobial activity
  misc_feature (4)..(4): Xaa can be any naturally occurring amino acid
  misc_feature (6)..(6): Xaa can be any naturally occurring amino acid
TYPXPXR

SEQ ID NO: 1735 - protein, 7 aa, Artificial
  Peptide with targeting and/or antimicrobial activity
TSQNVRT

SEQ ID NO: 1736 - protein, 7 aa, Artificial
  Peptide with targeting and/or antimicrobial activity
TYPLPIR

SEQ ID NO: 1737 - protein, 8 aa, Artificial
  Peptide with targeting and/or antimicrobial activity
TFRRLKWK

SEQ ID NO: 1738 - protein, 12 aa, Artificial
  Peptide with targeting and/or antimicrobial activity
RWKVRKSFFKLQ

SEQ ID NO: 1739 - protein, 12 aa, Artificial
  Peptide with targeting and/or antimicrobial activity
KWKAQKRFLKMS

SEQ ID NO: 1740 - protein, 17 aa, Artificial
  Peptide with targeting and/or antimicrobial activity
KCTSDQDEQFIPKGCSK

SEQ ID NO: 1741 - protein, 7 aa, Artificial
  Peptide with targeting and/or antimicrobial activity
YSPWTNF

SEQ ID NO: 1742 - protein, 21 aa, Artificial
  Peptide with targeting and/or antimicrobial activity
MKQQKKHIAALLFALILTLVS

SEQ ID NO: 1743 - protein, 7 aa, Artificial
  Peptide with targeting and/or antimicrobial activity
SIFTLVA

SEQ ID NO: 1744 - protein, 8 aa, Artificial
  Peptide with targeting and/or antimicrobial activity
LFSLVLAG

SEQ ID NO: 1745 - protein, 7 aa, Artificial
  Peptide with targeting and/or antimicrobial activity
AIFILAS

SEQ ID NO: 1746 - protein, 8 aa, Artificial
  Peptide with targeting and/or antimicrobial activity
FLVMFLSG

SEQ ID NO: 1747 - protein, 22 aa, Artificial
  Peptide with targeting and/or antimicrobial activity
DSIRDVSPTFNKIRRWFDGLFK

SEQ ID NO: 1748 - protein, 22 aa, Artificial
  Peptide with targeting and/or antimicrobial activity
MSKRAMKKIIPLITLFVVTLVG

SEQ ID NO: 1749 - protein, 9 aa, Artificial
  Peptide with targeting and/or antimicrobial activity
KDEIYWKPS

SEQ ID NO: 1750 - protein, 8 aa, Artificial
  Peptide with targeting and/or antimicrobial activity
YSTCDFIM

SEQ ID NO: 1751 - protein, 18 aa, Artificial
  Peptide with targeting and/or antimicrobial activity
GLWEDLLYNINRYAHYIT

SEQ ID NO: 1752 - protein, 19 aa, Artificial
  Peptide with targeting and/or antimicrobial activity
DIRHRINNSIWRDIFLKRK

SEQ ID NO: 1753 - protein, 19 aa, Artificial
  Peptide with targeting and/or antimicrobial activity
DVRSNKIRLWWENIFFNKK

SEQ ID NO: 1754 - protein, 8 aa, Artificial
  Peptide with targeting and/or antimicrobial activity
PTTREWDG

SEQ ID NO: 1755 - protein, 12 aa, Artificial
  Peptide with targeting and/or antimicrobial activity
LQIYTNGNWVPS

SEQ ID NO: 1756 - protein, 22 aa, Artificial
  Peptide with targeting and/or antimicrobial activity
MSKRAMKKIIPLITLFVVTLVG

SEQ ID NO: 1757 - protein, 21 aa, Artificial
  Peptide with targeting and/or antimicrobial activity
GAGKNLIYGMGYGYLRSCNRL

SEQ ID NO: 1758 - protein, 17 aa, Artificial
  Peptide with targeting and/or antimicrobial activity
EMRLSKFFRDFILQRKK

SEQ ID NO: 1759 - protein, 12 aa, Artificial
  Peptide with targeting and/or antimicrobial activity
WSEIEINTKQSN

SEQ ID NO: 1760 - protein, 10 aa, Artificial
  Peptide with targeting and/or antimicrobial activity
HISKERFEAY

SEQ ID NO: 1761 - protein, 21 aa, Artificial
  Peptide with targeting and/or antimicrobial activity
KYKCSWCKRVYTLRKDHRTAR

SEQ ID NO: 1762 - protein, 12 aa, Artificial
  Peptide with targeting and/or antimicrobial activity
WSEIEINTKQSN

SEQ ID NO: 1763 - protein, 23 aa, Artificial
  Peptide with targeting and/or antimicrobial activity
MKTTLKKLSRYIAVVIAITLIFI

SEQ ID NO: 1764 - protein, 10 aa, Artificial
  Peptide with targeting and/or antimicrobial activity
HISKERFEAY

SEQ ID NO: 1765 - protein, 17 aa, Artificial
  Peptide with targeting and/or antimicrobial activity
DKRLPYFFKHLFSNRTK

SEQ ID NO: 1766 - protein, 16 aa, Artificial
  Peptide with targeting and/or antimicrobial activity
EMRKPDGALFNLFRRR

SEQ ID NO: 1767 - protein, 16 aa, Artificial
  Peptide with targeting and/or antimicrobial activity
EMRKSNNNFFHFLRRI

SEQ ID NO: 1768 - protein, 17 aa, Artificial
  Peptide with targeting and/or antimicrobial activity
ESRLPKIRFDFIFPRKK

SEQ ID NO: 1769 - protein, 16 aa, Artificial
  Peptide with targeting and/or antimicrobial activity
EIRQTHNIFFNFFKRR

SEQ ID NO: 1770 - protein, 17 aa, Artificial
  Peptide with targeting and/or antimicrobial activity
DWRISETIRNLIFPRRK

SEQ ID NO: 1771 - protein, 8 aa, Artificial
  Peptide with targeting and/or antimicrobial activity
VAVLVLGA

SEQ ID NO: 1772 - protein, 11 aa, Artificial
  Peptide with targeting and/or antimicrobial activity
FFEDDKRKSFI

SEQ ID NO: 1773 - protein, 11 aa, Artificial
  Peptide with targeting and/or antimicrobial activity
FFEDDKRKSFI

SEQ ID NO: 1774 - protein, 40 aa, Artificial
  Peptide with targeting and/or antimicrobial activity
MKQKMYEAIAHLFKYVGAKQLVMCCVGIWFETKIPDELRK

SEQ ID NO: 1775 - protein, 40 aa, Artificial; identical to SEQ ID NO: 1774
  Peptide with targeting and/or antimicrobial activity

SEQ ID NO: 1776 - protein, 14 aa, Artificial
  Peptide with targeting and/or antimicrobial activity
VVAYVITQVGAIRF

SEQ ID NO: 1777 - protein, 14 aa, Artificial
  Peptide with targeting and/or antimicrobial activity
VVAYVITQVGAIRF

SEQ ID NO: 1778 - protein, 25 aa, Artificial
  Peptide with targeting and/or antimicrobial activity
LLKLQDDYLLHLERHRRTKKIIDEN

SEQ ID NO: 1779 - protein, 31 aa, Artificial
  Peptide with targeting and/or antimicrobial activity
EDIKDLTDKVQSLNALVQSELNKLIKRKDQS

SEQ ID NO: 1780 - protein, 19 aa, Artificial
  Peptide with targeting and/or antimicrobial activity
WFLDFSDWLSKVPSKLWAE

SEQ ID NO: 1781 - protein, 31 aa, Artificial; identical to SEQ ID NO: 1779
  Peptide with targeting and/or antimicrobial activity

SEQ ID NO: 1782 - protein, 19 aa, Artificial
  Peptide with targeting and/or antimicrobial activity
WFLDFSDWLSKVPSKLWAE

SEQ ID NO: 1783 - protein, 40 aa, Artificial
  Peptide with targeting and/or antimicrobial activity
MLSIFAQTTQTSASEPQQSPTAPQGRDNGSPIGYSSCVVA

SEQ ID NO: 1784 - protein, 38 aa, Artificial
  Peptide with targeting and/or antimicrobial activity
MLSIFETVAAAAPVTVAETQQASNNENRGQPGYYCLIA

SEQ ID NO: 1785 - protein, 34 aa, Artificial
  Peptide with targeting and/or antimicrobial activity
PSLPSSPPSLLPPLPLLKLLATRRPTLVGMTLCV

SEQ ID NO: 1786 - protein, 42 aa, Artificial
  Peptide with targeting and/or antimicrobial activity
MDSMANSVSSSSVVNAGNKPAETLNKTVKNYTPKVPYMCVIA

SEQ ID NO: 1787 - protein, 39 aa, Artificial
  Peptide with targeting and/or antimicrobial activity
MDTFTYVDLAAVAAAAVADEVPRDFEDQITDYQSYCIIC

SEQ ID NO: 1788 - protein, 10 aa, Artificial
  Peptide with targeting and/or antimicrobial activity
SNVHGWCVVA

SEQ ID NO: 1789 - protein, 11 aa, Artificial
  Peptide with targeting and/or antimicrobial activity
NTTAHGWCVVA

SEQ ID NO: 1790 - protein, 36 aa, Artificial
  Peptide with targeting and/or antimicrobial activity
MQPSTVTAAPKDKTSAEKKDNYIIKGVFWDPACVIA

SEQ ID NO: 1791 - protein, 9 aa, Artificial
  Peptide with targeting and/or antimicrobial activity
GPTWWCVNA

SEQ ID NO: 1792 - protein, 10 aa, Artificial
  Peptide with targeting and/or antimicrobial activity
SGPTWFCIIQ

SEQ ID NO: 1793 - protein, 31 aa, Artificial
  Peptide with targeting and/or antimicrobial activity
FTAIFSTLSSSVASKTDAPRNEEAYSSGNSP

SEQ ID NO: 1794 - protein, 42 aa, Artificial
  Peptide with targeting and/or antimicrobial activity
MFSIFAQPAQTSVSETQESPANHGANPGKSGSGLGYSTCVVA

SEQ ID NO: 1795 - protein, 11 aa, Artificial
  Peptide with targeting and/or antimicrobial activity
NTTAHGWCVVA

SEQ ID NO: 1796 - protein, 9 aa, Artificial
  Peptide with targeting and/or antimicrobial activity
SDDNYGSLA

SEQ ID NO: 1797 - protein, 10 aa, Artificial
  Peptide with targeting and/or antimicrobial activity
NGLTFWCVIA

SEQ ID NO: 1798 - protein, 8 aa, Artificial
  Peptide with targeting and/or antimicrobial activity
PSWFCVIA

SEQ ID NO: 1799 - protein, 8 aa, Artificial
  Peptide with targeting and/or antimicrobial activity
ASWFCTIA

SEQ ID NO: 1800 - protein, 25 aa, Artificial
  Peptide with targeting and/or antimicrobial activity
PHHKIANASDKRRRMYFEIFMCAVL

SEQ ID NO: 1801 - protein, 40 aa, Artificial; identical to SEQ ID NO: 1783
  Peptide with targeting and/or antimicrobial activity

SEQ ID NO: 1802 - protein, 38 aa, Artificial; identical to SEQ ID NO: 1784
  Peptide with targeting and/or antimicrobial activity

SEQ ID NO: 1803 - protein, 10 aa, Artificial
  Peptide with targeting and/or antimicrobial activity
SLTYAWCVVA

SEQ ID NO: 1804 - protein, 11 aa, Artificial
  Peptide with targeting and/or antimicrobial activity
TSMAHAWCVVA

SEQ ID NO: 1805 - protein, 6 aa, Artificial
  Peptide with targeting and/or antimicrobial activity
GYCVVA

SEQ ID NO: 1806 - protein, 40 aa, Artificial; identical to SEQ ID NO: 1783
  Peptide with targeting and/or antimicrobial activity

SEQ ID NO: 1807 - protein, 41 aa, Artificial
  Peptide with targeting and/or antimicrobial activity
MDSMANTVSSSVVNTGNKPSETLNKTVKNYTPKVPYMCVIA

SEQ ID NO: 1808 - protein, 39 aa, Artificial
  Peptide with targeting and/or antimicrobial activity
MFSLFETVAAAVKVVSAAEPEHAPTNEGKGEPAPYCIIA

SEQ ID NO: 1809 - protein, 8 aa, Artificial
  Peptide with targeting and/or antimicrobial activity
LTWFCVIA

SEQ ID NO: 1810 - protein, 18 aa, Artificial
  Peptide with targeting and/or antimicrobial activity
LREKRRRRWFEAFMGFGL

SEQ ID NO: 1811 - protein, 40 aa, Artificial; identical to SEQ ID NO: 1783
  Peptide with targeting and/or antimicrobial activity

SEQ ID NO: 1812 - protein, 40 aa, Artificial
  Peptide with targeting and/or antimicrobial activity
MDALTLFAPVSLGAVATEQAPVDEERPNRQTFPWIGCVVA

SEQ ID NO: 1813 - protein, 38 aa, Artificial
  Peptide with targeting and/or antimicrobial activity
MFIFESVVASVQAVSVAEQDQTPVSEGRGKPAVYCTIA

SEQ ID NO: 1814 - protein, 33 aa, Artificial
  Peptide with targeting and/or antimicrobial activity
PWMSLLFSFLALLALILPKLSKDDPLGLTRQPR

SEQ ID NO: 1815 - protein, 31 aa, Artificial
  Peptide with targeting and/or antimicrobial activity
ASISLIMEGSANIEAVGKLVWLAAALPLAFI

SEQ ID NO: 1816 - protein, 34 aa, Artificial
  Peptide with targeting and/or antimicrobial activity
ARNVYPSVETPLLQGAAPHDNKQSLVESPPPYVP

SEQ ID NO: 1817 - protein, 14 aa, Artificial
  Peptide with targeting and/or antimicrobial activity
FLKKLNRKIASIFN

SEQ ID NO: 1818 - protein, 20 aa, Artificial
  Peptide with targeting and/or antimicrobial activity
DSISRQGSISSGPPPRSPNK

SEQ ID NO: 1819 - protein, 5 aa, Artificial
  Peptide with targeting and/or antimicrobial activity
NNWNN

SEQ ID NO: 1820 - protein, 30 aa, Artificial
  Peptide with targeting and/or antimicrobial activity
GIPCGESCVWIPCISAALGCSCKNKVCYRN

SEQ ID NO: 1821 - protein, 38 aa, Artificial
  Peptide with targeting and/or antimicrobial activity
DFASCHTNGGICLPNRCPGHMIQIGICFRPRVKCCRSW

SEQ ID NO: 1822 - protein, 38 aa, Artificial
  Peptide with targeting and/or antimicrobial activity
GPLSCGRNGGVCIPIRCPVPMRQIGTCFGRPVKCCRSW

SEQ ID NO: 1823 - protein, 76 aa, Artificial
  Peptide with targeting and/or antimicrobial activity
SAFTVWSGPGCNNRAERYSKCGCSAIHQKGGYDFSYTGQTAALYNQAGCSGVAHTRFGSSARACNPFGWKSIFIQC

SEQ ID NO: 1824 - protein, 44 aa, Artificial
  Peptide with targeting and/or antimicrobial activity
YSRCQLQGFNCVVRSYGLPTIPCCRGLTCRSYFPGSTYGRCQRY

SEQ ID NO: 1825 - protein, 48 aa, Artificial
  Peptide with targeting and/or antimicrobial activity
VNYGNGVSCSKTKCSVNWGQAFQERYTAGINSFVSGVASGAGSIGRRP

SEQ ID NO: 1826 - protein, 25 aa, Artificial
  Peptide with targeting and/or antimicrobial activity
RSVCRQIKICRRRGGCYYKCTNRPY

SEQ ID NO: 1827 - protein, 13 aa, Artificial
  Peptide with targeting and/or antimicrobial activity
VRRFPWWWPFLRR

SEQ ID NO: 1828 - protein, 14 aa, Artificial
  Peptide with targeting and/or antimicrobial activity
INLKALAALAKKIL

SEQ ID NO: 1829 - protein, 20 aa, Artificial
  Peptide with targeting and/or antimicrobial activity
KWKLFKKIGIGKFLHSAKKF

SEQ ID NO: 1830 - protein, 30 aa, Artificial
  Peptide with targeting and/or antimicrobial activity
DCYCRIPACIAGERRYGTCIYQGRLWAFCC

SEQ ID NO: 1831 - protein, 62 aa, Artificial
  Peptide with targeting and/or antimicrobial activity
YLAFRCGRYSPCLDDGPNVNLYSCCSFYNCHKCLARLENCPKGLHYNAYLKVCDWPSKAGCT

SEQ ID NO: 1832 - protein, 23 aa, Artificial
  Peptide with targeting and/or antimicrobial activity
GIGKYLHSAKKFGKAWVGEIMNS

SEQ ID NO: 1833 - protein, 36 aa, Artificial
  Peptide with targeting and/or antimicrobial activity
DHYNCVSSGGQCLYSACPIFTKIQGTCYRGKAKCCK

SEQ ID NO: 1834 - protein, 32 aa, Artificial
  Peptide with targeting and/or antimicrobial activity
MPCSCKKYCDPWEVIDGSCGLFNSKYICCREK

SEQ ID NO: 1835 - protein, 18 aa, Artificial
  Peptide with targeting and/or antimicrobial activity
KWKLFKKIPKFLHSAKKF

SEQ ID NO: 1836 - protein, 20 aa, Artificial
  Peptide with targeting and/or antimicrobial activity
KLKLFKKIGIGKFLHSAKKF

SEQ ID NO: 1837 - protein, 20 aa, Artificial
  Peptide with targeting and/or antimicrobial activity
KAKLFKKIGIGKFLHSAKKF

SEQ ID NO: 1838 - protein, 41 aa, Artificial
  Peptide with targeting and/or antimicrobial activity
GIGDPVTCLKSGAICHPVFCPRRYKQIGTCGLPGTKCCKKP

SEQ ID NO: 1839 - protein, 39 aa, Artificial
  Peptide with targeting and/or antimicrobial activity
GFGCPNNYQCHRHCKSIPGRCGGYCGGWHRLPCTCYRCG

SEQ ID NO: 1840 - protein, 29 aa, Artificial
  Peptide with targeting and/or antimicrobial activity
RGLRRLGRKIAHGVKKYGPTVLRIIRIAG

SEQ ID NO: 1841 - protein, 13 aa, Artificial
  Peptide with targeting and/or antimicrobial activity
ILPWKWPWWPWRR

SEQ ID NO: 1842 - protein, 21 aa, Artificial
  Peptide with targeting and/or antimicrobial activity
VGIGTPISFYGGGAGHVPEYF

SEQ ID NO: 1843 - protein, 13 aa, Artificial
  Peptide with targeting and/or antimicrobial activity
ILAWKWAWWAWRR

SEQ ID NO: 1844 - protein, 18 aa, Artificial
  Peptide with targeting and/or antimicrobial activity
KNLRRIIRKIIHIIKKYG

SEQ ID NO: 1845 - protein, 18 aa, Artificial
  Peptide with targeting and/or antimicrobial activity
KNLRRIIRKGIHIIKKYG

SEQ ID NO: 1846 - protein, 18 aa, Artificial
  Peptide with targeting and/or antimicrobial activity
KNLRRITRKIIHIIKKYG

SEQ ID NO: 1847 - protein, 18 aa, Artificial
  Peptide with targeting and/or antimicrobial activity
GFCRCLCRRGVCRCICTR

SEQ ID NO: 1848 - protein, 44 aa, Artificial
  Peptide with targeting and/or antimicrobial activity
DKLIGSCVWGAVNYTSDCNGECLLRGYKGGHCGSFANVNCWCET

SEQ ID NO: 1849 - protein, 40 aa, Artificial
  Peptide with targeting and/or antimicrobial activity
ATCDLLSGTGINHSACAAHCLLRGNRGGYCNGKGVCVCRN

SEQ ID NO: 1850 - protein, 15 aa, Artificial
  Peptide with targeting and/or antimicrobial activity
VGALAVVVWLFLWLW

SEQ ID NO: 1851 - protein, 15 aa, Artificial
  Peptide with targeting and/or antimicrobial activity
VGALAVVVWLYLWLW

SEQ ID NO: 1852 - protein, 18 aa, Artificial
  Peptide with targeting and/or antimicrobial activity
ECRRLCYKQRCVTYCRGR

SEQ ID NO: 1853 - protein, 45 aa, Artificial
  Peptide with targeting and/or antimicrobial activity
GIINTLQKYYCRVRGGRCAVLSCLPKEEQIGKCSTRGRKCCRRKK

SEQ ID NO: 1854 - protein, 42 aa, Artificial
  Peptide with targeting and/or antimicrobial activity
AKIPIKAIKTVGKAVGKGLRAINIASTANDVFNFLKPKKRKA

SEQ ID NO: 1855 - protein, 40 aa, Artificial
  Peptide with targeting and/or antimicrobial activity
ATCDLLSGTGINHSACAAHCLLRGNRGGYCNGKAVCVCRN

SEQ ID NO: 1856 - protein, 83 aa, Artificial
  Peptide with targeting and/or antimicrobial activity
GRDYRTCLTIVQKLKKMVDKPTQRSVSNAATRVCTRGRSRWRDVCRNFMRRYQSRVIQGLVAGETAQQICEDLRLCIPSTGPL

SEQ ID NO: 1857 - protein, 25 aa, Artificial
  Peptide with targeting and/or antimicrobial activity
FKCRRWQWRMKKLGAPSITCVRRAF

SEQ ID NO: 1858 - protein, 25 aa, Artificial
  Peptide with targeting and/or antimicrobial activity
DTHFPICIFCCGCCHRSKCGMCCKT

SEQ ID NO: 1859 - protein, 15 aa, Artificial
  Peptide with targeting and/or antimicrobial activity
VGALAVVVWLWLWLW

SEQ ID NO: 1860 - protein, 36 aa, Artificial
  Peptide with targeting and/or antimicrobial activity
ACNFQSCWATCQAQHSIYFRRAFCDRSQCKCVFVRG

SEQ ID NO: 1861 - protein, 30 aa, Artificial
  Peptide with targeting and/or antimicrobial activity
VGECVRGRCPSGMCCSQFGYCGKGPKYCGR

SEQ ID NO: 1862 - protein, 20 aa, Artificial
  Peptide with targeting and/or antimicrobial activity
CTFTLPGGGGVCTLTSECIC

SEQ ID NO: 1863 - protein, 78 aa, Artificial
  Peptide with targeting and/or antimicrobial activity
GYFCESCRKIIQKLEDMVGPQPNEDTVTQAASQVCDKLKILRGLCKKIMRSFLRRISWDILTGKKPQAICVDIKICKE

SEQ ID NO: 1864 - protein, 43 aa, Artificial
  Peptide with targeting and/or antimicrobial activity
KYYGNGVHCGKHSCTVDWGTAIGNIGNNAAANWATGGNAGWNK

SEQ ID NO: 1865 - protein, 18 aa, Artificial
  Peptide with targeting and/or antimicrobial activity
RGGRLCYCRRRFCVCVGR

SEQ ID NO: 1866 - protein, 35 aa, Artificial
  Peptide with targeting and/or antimicrobial activity
NKGCATCSIGAACLVDGPIPDFEIAGATGLFGLWG

SEQ ID NO: 1867 - protein, 21 aa, Artificial
  Peptide with targeting and/or antimicrobial activity
VGIGTPIFSYGGGAGHVPEYF

SEQ ID NO: 1868 - protein, 18 aa, Artificial
  Peptide with targeting and/or antimicrobial activity
RRWCFRVCYRGFCYRKCR

SEQ ID NO: 1869 - protein, 13 aa, Artificial
  Peptide with targeting and/or antimicrobial activity
ILGKIWEGIKSLF

SEQ ID NO: 1870 - protein, 38 aa, Artificial
  Peptide with targeting and/or antimicrobial activity
SFGLCRLRRGFCARGRCRFPSIPIGRCSRFVQCCRRVW

SEQ ID NO: 1871 - protein, 13 aa, Artificial
  Peptide with targeting and/or antimicrobial activity
GLFDIIKKIAESF

SEQ ID NO: 1872 - protein, 17 aa, Artificial
  Peptide with targeting and/or antimicrobial activity
KWCFRVCYRGICYRRCR

SEQ ID NO: 1873 - protein, 33 aa, Artificial
  Peptide with targeting and/or antimicrobial activity
GFFALIPKIISSPLFKTLLSAVGSALSSSGGQE

SEQ ID NO: 1874 - protein, 25 aa, Artificial
  Peptide with targeting and/or antimicrobial activity
NLVSGLIEARKYLEQLHRKLKNCKV

SEQ ID NO: 1875 - protein, 47 aa, Artificial
  Peptide with targeting and/or antimicrobial activity
HSSGYTRPLRKPSRPIFIRPIGCDVCYGIPSSTARLCCFRYGDCCHL

SEQ ID NO: 1876 - protein, 26 aa, Artificial
  Peptide with targeting and/or antimicrobial activity
KSSAYSLQMGATAIKQVKKLFKKWGW

SEQ ID NO: 1877 - protein, 25 aa, Artificial
  Peptide with targeting and/or antimicrobial activity
GWGSFFKKAAHVGKHVGKAALTHYL

SEQ ID NO: 1878 - protein, 49 aa, Artificial
  Peptide with targeting and/or antimicrobial activity
GRRRRSVQWCAVSQPEATKCFQWQRNMRKVRGPPVSCIKRDSPIQCIQA

SEQ ID NO: 1879 - protein, 40 aa, Artificial
  Peptide with targeting and/or antimicrobial activity
GFGCNGPWDEDDMQCHNHCKSIKGYKGGYCAKGGFVCKCY

SEQ ID NO: 1880 - protein, 29 aa, Artificial
  Peptide with targeting and/or antimicrobial activity
CYCRIPACIAGERRYGTCIYQGRLWAFCC

SEQ ID NO: 1881 - protein, 34 aa, Artificial
  Peptide with targeting and/or antimicrobial activity
VCSCRLVFCRRTELRVGNCLIGGVSFTYCCTRVD

SEQ ID NO: 1882 - protein, 35 aa, Artificial
  Peptide with targeting and/or antimicrobial activity
QARATCYCRTGRCATRESLSGVCEISGRLYRLCCR

SEQ ID NO: 1883 - protein, 35 aa, Artificial
  Peptide with targeting and/or antimicrobial activity
STRAFTCHCRRSCYSTEYSYGTCTVMGINHRFCCL

SEQ ID NO: 1884 - protein, 25 aa, Artificial
  Peptide with targeting and/or antimicrobial activity
HVDKKVADKVLLLKQLRIMRLLTRL

SEQ ID NO: 1885 - protein, 42 aa, Artificial
  Peptide with targeting and/or antimicrobial activity
RGFRKHFNKLVKKVKHTISETAHVAKDTAVIAGSGAAVVAAT

SEQ ID NO: 1886 - protein, 41 aa, Artificial
  Peptide with targeting and/or antimicrobial activity
ARSYGNGVYCNNKKCWVNRGEATQSIIGGMISGWASGLAGM

SEQ ID NO: 1887 - protein, 43 aa, Artificial
  Peptide with targeting and/or antimicrobial activity
GFGCPGNQLKCNNHCKSISCRAGYCDAATLWLRCTCTDCNGKK

SEQ ID NO: 1888 - protein, 47 aa, Artificial
  Peptide with targeting and/or antimicrobial activity
AIKLVQSPNGNFAASFVLDGTKWIFKSKYYDSSKGYWVGIYEVWDRK

SEQ ID NO: 1889 - protein, 42 aa, Artificial
  Peptide with targeting and/or antimicrobial activity
YVSCLFRGARCRVYSGRSCCFGYYCRRDFPGSIFGTCSRRNF

SEQ ID NO: 1890 - protein, 42 aa, Artificial
  Peptide with targeting and/or antimicrobial activity
YITCLFRGARCRVYSGRSCCFGYYCRRDFPGSIFGTCSRRNF

SEQ ID NO: 1891 - protein, 31 aa, Artificial
  Peptide with targeting and/or antimicrobial activity
CGESCVFIPCISTLLGCSCKNKVCYRNGVIP

SEQ ID NO: 1892 - protein, 13 aa, Artificial
  Peptide with targeting and/or antimicrobial activity
RLFDKIRQVIRKF

SEQ ID NO: 1893 - protein, 13 aa, Artificial
  Peptide with targeting and/or antimicrobial activity
FKRIVQRIKDFLR

SEQ ID NO: 1894 - protein, 37 aa, Artificial
  Peptide with targeting and/or antimicrobial activity
GILDTLKQFAKGVGKDLVKGAAQGVLSTVSCKLAKTC

SEQ ID NO: 1895 - protein, 26 aa, Artificial
  Peptide with targeting and/or antimicrobial activity
GLFGKLIKKFGRKAISYAVKKARGKH

SEQ ID NO: 1896 - protein, 32 aa, Artificial
  Peptide with targeting and/or antimicrobial activity
LVQRGRFGRFLRKIRRFRPKVTITIQGSARFG

SEQ ID NO: 1897 - protein, 47 aa, Artificial
  Peptide with targeting and/or antimicrobial activity
KTCENLANTYRGPCFTTGSCDDHCKNKEHLRSGRCRDDFRCWCTRNC

SEQ ID NO: 1898 - protein, 32 aa, Artificial
  Peptide with targeting and/or antimicrobial activity
GLLCYCRKGHCKRGERVRGTCGIRFLYCCPRR

SEQ ID NO: 1899 - protein, 29 aa, Artificial
  Peptide with targeting and/or antimicrobial activity
RVKRFWPLVPVAINTVAAGINLYKAIRRK

SEQ ID NO: 1900 - protein, 15 aa, Artificial
  Peptide with targeting and/or antimicrobial activity
KWKLFKKIGAVLKVL

SEQ ID NO: 1901 - protein, 21 aa, Artificial
  Peptide with targeting and/or antimicrobial activity
RWCVYAYVRIRGVLVRYRRCW

SEQ ID NO: 1902 - protein, 22 aa, Artificial
  Peptide with targeting and/or antimicrobial activity
FFHHIFRGIVHVGKTIHRLVTG

SEQ ID NO: 1903 - protein, 39 aa, Artificial
  Peptide with targeting and/or antimicrobial activity
GTWDDIGQGIGRVAYWVGKALGNLSDVNQASRINRKKKH

SEQ ID NO: 1904 - protein, 19 aa, Artificial
  Peptide with targeting and/or antimicrobial activity
FLSLIPHAINAVSTLVHHF

SEQ ID NO: 1905 - protein, 19 aa, Artificial
  Peptide with targeting and/or antimicrobial activity
FLSLIPHAINAVSAIAKHN

SEQ ID NO: 1906 - protein, 19 aa, Artificial
  Peptide with targeting and/or antimicrobial activity
FLSLIPHAINAVSALANHG

SEQ ID NO: 1907 - protein, 21 aa, Artificial
  Peptide with targeting and/or antimicrobial activity
RWCVYAYVRVRGVLVRYRRCW

SEQ ID NO: 1908 - protein, 32 aa, Artificial
  Peptide with targeting and/or antimicrobial activity
GILSSFKGVAKGVAKDLAGKLLETLKCKITGC

SEQ ID NO: 1909 - protein, 35 aa, Artificial
  Peptide with targeting and/or antimicrobial activity
GFGALFKFLAKKVAKTVAKQAAKQGAKYVVNKQME

SEQ ID NO: 1910 - protein, 37 aa, Artificial
  Peptide with targeting and/or antimicrobial activity
LLGDFFRKSKEKIGKEFKRIVQRIKDFLRNLVPRTES

SEQ ID NO: 1911 - protein, 37 aa, Artificial
  Peptide with targeting and/or antimicrobial activity
KYYGNGVHCTKSGCSVNWGEAFSAGVHRLANGGNGFW

SEQ ID NO: 1912 - protein, 23 aa, Artificial
  Peptide with targeting and/or antimicrobial activity
GIGKFLHSAKKFGKAFVGEIMNS

SEQ ID NO: 1913 - protein, 26 aa, Artificial
  Peptide with targeting and/or antimicrobial activity
GIGAVLKVLTTGLPALISWIKRKRQQ

SEQ ID NO: 1914 - protein, 26 aa, Artificial
  Peptide with targeting and/or antimicrobial activity
SMWSGMWRRKLKKLRNALKKKLKGEK

SEQ ID NO: 1915 - protein, 30 aa, Artificial
  Peptide with targeting and/or antimicrobial activity
ACYCRIPACIAGERRYGTCIYQGRLWAFCC

SEQ ID NO: 1916 - protein, 17 aa, Artificial
  Peptide with targeting and/or antimicrobial activity
ALYKKFKKKLLKSLKRL

SEQ ID NO: 1917 - protein, 21 aa, Artificial
  Peptide with targeting and/or antimicrobial activity
GSKKPVPIIYCNRRTGKCQRM

SEQ ID NO: 1918 - protein, 7 aa, Artificial
  Peptide with targeting and/or antimicrobial activity
GSEIQPR

SEQ ID NO: 1919 - protein, 21 aa, Artificial
  Peptide with targeting and/or antimicrobial activity
KSWSLCTPGCARTGSFNSYCC

SEQ ID NO: 1920 - protein, 37 aa, Artificial
  Peptide with targeting and/or antimicrobial activity
SRWPSPGRPRPFPGRPKPIFRPRPCNCYAPPCPCDRW

SEQ ID NO: 1921 - protein, 25 aa, Artificial
  Peptide with targeting and/or antimicrobial activity
GSGVIPTISHECHMNSFQFVFTCCS

SEQ ID NO: 1922 - protein, 32 aa, Artificial
  Peptide with targeting and/or antimicrobial activity
DLRFWNPREKLPLPTLPPFNPKPIYIDMGNRY

SEQ ID NO: 1923 - protein, 34 aa, Artificial
  Peptide with targeting and/or antimicrobial activity
VFIDILDKMENAIHKAAQAGIGIAKPIEKMILPK

SEQ ID NO: 1924 - protein, 36 aa, Artificial
  Peptide with targeting and/or antimicrobial activity
SIGTAVKKAVPIAKKVGKVAIPIAKAVLSVVGQLVG

SEQ ID NO: 1925 - protein, 31 aa, Artificial
  Peptide with targeting and/or antimicrobial activity
GWFGKAFRSVSNFYKKHKTYIHAGLSAATLL

SEQ ID NO: 1926 - protein, 32 aa, Artificial
  Peptide with targeting and/or antimicrobial activity
GWLRKAAKSVGKFYYKHKYYIKAAWQIGKHAL

SEQ ID NO: 1927 - protein, 32 aa, Artificial
  Peptide with targeting and/or antimicrobial activity
GWLRKAAKSVGKFYYKHKYYIKAAWKIGRHAL

SEQ ID NO: 1928 - protein, 27 aa, Artificial
  Peptide with targeting and/or antimicrobial activity
NRWWQGVVPTVSYECRMNSWQHVFTCC

SEQ ID NO: 1929 - protein, 38 aa, Artificial
  Peptide with targeting and/or antimicrobial activity
AKCIKNGKGCREDQGPPFCCSGFCYRQVGWARGYCKNR

SEQ ID NO: 1930 - protein, 42 aa, Artificial
  Peptide with targeting and/or antimicrobial activity
AKIPIKAIKTVGKAVGKGLRAINIASTANDVFNFLKPKKRKH

SEQ ID NO: 1931 - protein, 13 aa, Artificial
  Peptide with targeting and/or antimicrobial activity
SYSMEHFRWGKPV

SEQ ID NO: 1932 - protein, 33 aa, Artificial
  Peptide with targeting and/or antimicrobial activity
VVCACRRALCLPRERRAGFCRIRGRIHPLCCRR

SEQ ID NO: 1933 - protein, 33 aa, Artificial
  Peptide with targeting and/or antimicrobial activity
VVCACRRALCLPLERRAGFCRIRGRIHPLCCRR

SEQ ID NO: 1934 - protein, 24 aa, Artificial
  Peptide with targeting and/or antimicrobial activity
GIGALSAKGALKGLAKGLAEHFAN

SEQ ID NO: 1935 - protein, 37 aa, Artificial
  Peptide with targeting and/or antimicrobial activity
KWKLFKKIEKVGQNIRDGIIKAGPAVAVVGQATQIAK

SEQ ID NO: 1936 - protein, 35 aa, Artificial
  Peptide with targeting and/or antimicrobial activity
KWKIFKKIEKVGRNIRNGIIKAGPAVAVLGEAKAL

SEQ ID NO: 1937 - protein, 36 aa, Artificial
  Peptide with targeting and/or antimicrobial activity
WNPFKELERAGQRVRDAIISAGPAVATVAQATALAK

SEQ ID NO: 1938 - protein, 13 aa, Artificial
  Peptide with targeting and/or antimicrobial activity
FLPLILRKIVTAL

SEQ ID NO: 1939 - protein, 35 aa, Artificial
  Peptide with targeting and/or antimicrobial activity
RWKIFKKIEKMGRNIRDGIVKAGPAIEVLGSAKAI

SEQ ID NO: 1940 - protein, 14 aa, Artificial
  Peptide with targeting and/or antimicrobial activity
INLKAIAALAKKLL

SEQ ID NO: 1941 - protein, 47 aa, Artificial
  Peptide with targeting and/or antimicrobial activity
SDEKASPDKHHRFSLSRYAKLANRLANPKLLETFLSKWIGDRGNRSV

SEQ ID NO: 1942 - protein, 33 aa, Artificial
  Peptide with targeting and/or antimicrobial activity
VFCTCRGFLCGSGERASGSCTINGVRHTLCCRR

SEQ ID NO: 1943 - protein, 33 aa, Artificial
  Peptide with targeting and/or antimicrobial activity
VSCTCRRFSCGFGERASGSCTVNGVRHTLCCRR

SEQ ID NO: 1944 - protein, 34 aa, Artificial
  Peptide with targeting and/or antimicrobial activity
GRCVCRKQLLCSYRERRIGDCKIRGVRFPFCCPR

SEQ ID NO: 1945 - protein, 33 aa, Artificial
  Peptide with targeting and/or antimicrobial activity
ICACRRRFCPNSERFSGYCRVNGARYVRCCSRR

SEQ ID NO: 1946 - protein, 34 aa, Artificial
  Peptide with targeting and/or antimicrobial activity
GICACRRRFCPNSERFSGYCRVNGARYVRCCSRR

SEQ ID NO: 1947 - protein, 17 aa, Artificial
  Peptide with targeting and/or antimicrobial activity
SKITDILAKLGKVLAHV

SEQ ID NO: 1948 - protein, 17 aa, Artificial
  Peptide with targeting and/or antimicrobial activity
IKIMDILAKLGKVLAHV

SEQ ID NO: 1949 - protein, 17 aa, Artificial
  Peptide with targeting and/or antimicrobial activity
INIKDILAKLVKVLGHV

SEQ ID NO: 1950 - protein, 17 aa, Artificial
  Peptide with targeting and/or antimicrobial activity
INVLGILGLLGKALSHL

SEQ ID NO: 1951 - protein, 47 aa, Artificial
  Peptide with targeting and/or antimicrobial activity
KSCCRNTWARNCYNVCRLPGTISREICAKKCDCKIISGTTCPSDYPK

SEQ ID NO: 1952 - protein, 39 aa, Artificial
  Peptide with targeting and/or antimicrobial activity
GWLKKIGKKIERVGQHTRDATIQGLGIAQQAANVAATAR

SEQ ID NO: 1953 - protein, 39 aa, Artificial
  Peptide with targeting and/or antimicrobial activity
GWLKKIGKKIERVGQHTRDATIQVIGVAQQAANVAATAR

SEQ ID NO: 1954 - protein, 39 aa, Artificial
  Peptide with targeting and/or antimicrobial activity
GWLRKIGKKIERVGQHTRDATIQVLGIAQQAANVAATAR

SEQ ID NO: 1955 - protein, 17 aa, Artificial
  Peptide with targeting and/or antimicrobial activity
IKITTMLAKLGKVLAHV

SEQ ID NO: 1956 - protein, 32 aa, Artificial
  Peptide with targeting and/or antimicrobial activity
WKSESLCTPGCVTGALQTCFLQTLTCNCKISK

SEQ ID NO: 1957 - protein, 35 aa, Artificial
  Peptide with targeting and/or antimicrobial activity
LRDLVCYCRARGCKGRERMNGTCRKGHLLYMLCCR

SEQ ID NO: 1958 - protein, 34 aa, Artificial
  Peptide with targeting and/or antimicrobial activity
ITSISLCTPGCKTGALMGCNMKTATCHCSIHVSK

SEQ ID NO: 1959 - protein, 17 aa, Artificial
  Peptide with targeting and/or antimicrobial activity
RWCFRVCYRGICYRKCR

SEQ ID NO: 1960 - protein, 18 aa, Artificial
  Peptide with targeting and/or antimicrobial activity
RRWCFRVCYKGFCYRKCR

SEQ ID NO: 1961 - protein, 31 aa, Artificial
  Peptide with targeting and/or antimicrobial activity
SWLSKTAKKLENSAKKRISEGIAIAIQGGPR

SEQ ID NO: 1962 - protein, 37 aa, Artificial
  Peptide with targeting and/or antimicrobial activity
WNPFKELERAGQRVRDAVISAAPAVATVGQAAAIARG

SEQ ID NO: 1963 - protein, 37 aa, Artificial
  Peptide with targeting and/or antimicrobial activity
WNPFKELERAGQRVRDAIISAGPAVATVGQAAAIARG

SEQ ID NO: 1964 - protein, 37 aa, Artificial
  Peptide with targeting and/or antimicrobial activity
WNPFKELERAGQRVRDAIISAAPAVATVGQAAAIARG

SEQ ID NO: 1965 - protein, 36 aa, Artificial
  Peptide with targeting and/or antimicrobial activity
WNPFKELERAGQRVRDAVISAAAVATVGQAAAIARG

SEQ ID NO: 1966 - protein, 35 aa, Artificial
  Peptide with targeting and/or antimicrobial activity
RWKIFKKIEKVGQNIRDGIVKAGPAVAVVGQAATI

SEQ ID NO: 1967 - protein, 34 aa, Artificial
  Peptide with targeting and/or antimicrobial activity
YVPLPNVPQPGRRPFPTFPGQGPFNPKIKWPQGY

SEQ ID NO: 1968 - protein, 24 aa, Artificial
  Peptide with targeting and/or antimicrobial activity
DSHAKRHHGYKRKFHEKHHSHRGY

SEQ ID NO: 1969 - protein, 32 aa, Artificial
  Peptide with targeting and/or antimicrobial activity
DSHAKRHHGYKRKFHEKHHSHRGYRSNYLYDN

SEQ ID NO: 1970 - protein, 12 aa, Artificial
  Peptide with targeting and/or antimicrobial activity
KFHEKHHSHRGY

SEQ ID NO: 1971 - protein, 51 aa, Artificial
  Peptide with targeting and/or antimicrobial activity
VTCDLLSFKGQVNDSACAANCLSLGKAGGHCEKVGCICRKTSFKDLWDKRF

SEQ ID NO: 1972 - protein, 17 aa, Artificial
  Peptide with targeting and/or antimicrobial activity
KWCFRVCYRGICYRKCR

SEQ ID NO: 1973 - protein, 40 aa, Artificial
  Peptide with targeting and/or antimicrobial activity
GWIRDFGKRIERVGQHTRDATIQTIAVAQQAANVAATLKG

SEQ ID NO: 1974 - protein, 34 aa, Artificial
  Peptide with targeting and/or antimicrobial activity
TAGPAIRASVKQCQKTLKATRLFTVSCKGKNGCK

SEQ ID NO: 1975 - protein, 43 aa, Artificial
  Peptide with targeting and/or antimicrobial activity
RFRPPIRRPPIRPPFYPPFRPPIRPPIFPPIRPPFRPPLGPFP

SEQ ID NO: 1976 - protein, 60 aa, Artificial
  Peptide with targeting and/or antimicrobial activity
RRIRPRPPRLPRPRPRPLPFPRPGPRPIPRPLPFPRPGPRPIPRPLPFPRPGPRPIPRPL

SEQ ID NO: 1977 - protein, 14 aa, Artificial
  Peptide with targeting and/or antimicrobial activity
LKLKSIVSWAKKVL

SEQ ID NO: 1978 - protein, 34 aa, Artificial
  Peptide with targeting and/or antimicrobial activity
VFIDILDKVENAIHNAAQVGIGFAKPFEKLINPK

SEQ ID NO: 1979 - protein, 12 aa, Artificial
  Peptide with targeting and/or antimicrobial activity
RLCRIVVIRVCR

SEQ ID NO: 1980 - protein, 37 aa, Artificial
  Peptide with targeting and/or antimicrobial activity
STPVLASVAVSMELLPTASVLYSDVAGCFKYSAKHHC

SEQ ID NO: 1981 - protein, 25 aa, Artificial
  Peptide with targeting and/or antimicrobial activity
GWASKIGQTLGKIAKVGLKELIQPK

SEQ ID NO: 1982 - protein, 38 aa, Artificial
  Peptide with targeting and/or antimicrobial activity
NPVSCVRNKGICVPIRCPGSMKQIGTCVGRAVKCCRKK

SEQ ID NO: 1983 - protein, 37 aa, Artificial
  Peptide with targeting and/or antimicrobial activity
GLRKRLRKFRNKIKEKLKKIGQKIQGFVPKLAPRTDY

SEQ ID NO: 1984 - protein, 37 aa, Artificial
  Peptide with targeting and/or antimicrobial activity
QCIGNGGRCNENVGPPYCCSGFCLRQPGQGYGYCKNR

SEQ ID NO: 1985 - protein, 36 aa, Artificial
  Peptide with targeting and/or antimicrobial activity
CIGNGGRCNENVGPPYCCSGFCLRQPNQGYGVCRNR

SEQ ID NO: 1986 - protein, 35 aa, Artificial
  Peptide with targeting and/or antimicrobial activity
LRDLVCYCRKRGCKRRERMNGTCRKGHLMYTLCCR

SEQ ID NO: 1987 - protein, 33 aa, Artificial
  Peptide with targeting and/or antimicrobial activity
RSGRGECRRQCLRRHEGQPWETQECMRRCRRRG

SEQ ID NO: 1988 - protein, 27 aa, Artificial
  Peptide with targeting and/or antimicrobial activity
GIGASILSAGKSALKGLAKGLAEHFAN

SEQ ID NO: 1989 - protein, 27 aa, Artificial
  Peptide with targeting and/or antimicrobial activity
GIGSAILSAGKSALKGLAKGLAEHFAN

SEQ ID NO: 1990 - protein, 25 aa, Artificial
  Peptide with targeting and/or antimicrobial activity
GIGAAILSAGKSALKGLAKGLAEHF

SEQ ID NO: 1991 - protein, 25 aa, Artificial
  Peptide with targeting and/or antimicrobial activity
GIGAAILSAGKSIIKGLANGLAEHF

SEQ ID NO: 1992 - protein, 44 aa, Artificial
  Peptide with targeting and/or antimicrobial activity
KYYGNGVTCGKHSCSVDWGKATTCIINNGAMAWATGGHQGNHKC

SEQ ID NO: 1993 - protein, 34 aa, Artificial
  Peptide with targeting and/or antimicrobial activity
ITSISLCTPGCKTGALMGCNMKTATCNCSIHVSK

SEQ ID NO: 1994 - protein, 39 aa, Artificial
  Peptide with targeting and/or antimicrobial activity
GWLKKLGKRIERIGQHTRDATIQGLGIAQQAANVAATAR

SEQ ID NO: 1995 - protein, 33 aa, Artificial
  Peptide with targeting and/or antimicrobial activity
GLWSKIKEVGKEAAKAAAKAAGKAALGAVSEAV

SEQ ID NO: 1996 - protein, 34 aa, Artificial
  Peptide with targeting and/or antimicrobial activity
LTCEIDRSLCLLHCRLKGYLRAYCSQQKVCRCVQ

SEQ ID NO: 1997 - protein, 40 aa, Artificial
  Peptide with targeting and/or antimicrobial activity
ATCDLLSGIGVQHSACALHCVFRGNRGGYCTGKGICVCRN

SEQ ID NO: 1998 - protein, 16 aa, Artificial
  Peptide with targeting and/or antimicrobial activity
RGGRLCYCRRRFCICV

SEQ ID NO: 1999 - protein, 18 aa, Artificial
  Peptide with targeting and/or antimicrobial activity
RGGGLCYCRRRFCVCVGR

SEQ ID NO: 2000 - protein, 24 aa, Artificial
  Peptide with targeting and/or antimicrobial activity
FLPLLAGLAANFLPKIFCKITRKC

SEQ ID NO: 2001 - protein, 46 aa, Artificial
  Peptide with targeting and/or antimicrobial activity
GIFSKLGRKKIKNLLISGLKNVGKEVGMDVVRTGIDIAGCKIKGEC

SEQ ID NO: 2002 - protein, 24 aa, Artificial
  Peptide with targeting and/or antimicrobial activity
FLPVLAGIAAKVVPALFCKITKKC

SEQ ID NO: 2003 - protein, 33 aa, Artificial
  Peptide with targeting and/or antimicrobial activity
GLLDSLKGFAATAGKGVLQSLLSTASCKLAKTC

SEQ ID NO: 2004 - protein, 38 aa, Artificial
  Peptide with targeting and/or antimicrobial activity
DSHEERHHGRHGHHKYGRKFHEKHHSHRGYRSNYLYDN

SEQ ID NO: 2005 - protein, 18 aa, Artificial
  Peptide with targeting and/or antimicrobial activity
GNNRPVYIPQPRPPHPRI

SEQ ID NO: 2006 - protein, 18 aa, Artificial
  Peptide with targeting and/or antimicrobial activity
GNNRPVYIPQPRPPHPRL

SEQ ID NO: 2007 - protein, 29 aa, Artificial
  Peptide with targeting and/or antimicrobial activity
SIGSALKKALPVAKKIGKIALPIAKAALP

SEQ ID NO: 2008 - protein, 29 aa, Artificial
  Peptide with targeting and/or antimicrobial activity
SIGSAFKKALPVAKKIGKAALPIAKAALP

SEQ ID NO: 2009 - protein, 19 aa, Artificial
  Peptide with targeting and/or antimicrobial activity
GKPRPYSPRPTSHPRPIRV

SEQ ID NO: 2010 - protein, 20 aa, Artificial
  Peptide with targeting and/or antimicrobial activity
VDKGSYLPRPTPPRPIYNRN

SEQ ID NO: 2011 - protein, 37 aa, Artificial
  Peptide with targeting and/or antimicrobial activity
KYYGNGVHCTKSGCSVNWGEAASAGIHRLANGGNGFW

SEQ ID NO: 2012 - protein, 43 aa, Artificial
  Peptide with targeting and/or antimicrobial activity
AISYGNGVYCNKEKCWVNKAENKQAITGIVIGGWASSLAGMGH

SEQ ID NO: 2013 - protein, 24 aa, Artificial
  Peptide with targeting and/or antimicrobial activity
GVLSNVIGYLKKLGTGALNAVLKQ

SEQ ID NO: 2014 - protein, 20 aa, Artificial
  Peptide with targeting and/or antimicrobial activity
FLGGLIKIVPAMICAVTKKC

SEQ ID NO: 2015 - protein, 24 aa, Artificial
  Peptide with targeting and/or antimicrobial activity
FLPAIFRMAAKVVPTIICSITKKC

SEQ ID NO: 2016 - protein, 23 aa, Artificial
  Peptide with targeting and/or antimicrobial activity
VIPFVASVAAEMQHVYCAASRKC

SEQ ID NO: 2017 - protein, 33 aa, Artificial
  Peptide with targeting and/or antimicrobial activity
GILDTLKNLAISAAKGAAQGLVNKASCKLSGQC

SEQ ID NO: 2018 - protein, 33 aa, Artificial
  Peptide with targeting and/or antimicrobial activity
GILDTLKNLAKTAGKGALQGLVKMASCKLSGQC

SEQ ID NO: 2019 - protein, 34 aa, Artificial
  Peptide with targeting and/or antimicrobial activity
GILLDKLKNFAKTAGKGVLQSLLNTASCKLSGQC

SEQ ID NO: 2020 - protein, 29 aa, Artificial
  Peptide with targeting and/or antimicrobial activity
GILDSLKNLAKNAGQILLNKASCKLSGQC

SEQ ID NO: 2021 - protein, 46 aa, Artificial
  Peptide with targeting and/or antimicrobial activity
GIFSKLAGKKIKNLLISGLKNVGKEVGMDVVRTGIDIAGCKIKGEC

SEQ ID NO: 2022 - protein, 46 aa, Artificial
  Peptide with targeting and/or antimicrobial activity
GIFSKLAGKKLKNLLISGLKNVGKEVGMDVVRTGIDIAGCKIKGEC

SEQ ID NO: 2023 - protein, 37 aa, Artificial
  Peptide with targeting and/or antimicrobial activity
GILSLVKGVAKLAGKGLAKEGGKFGLELIACKIAKQC

SEQ ID NO: 2024 - protein, 37 aa, Artificial
  Peptide with targeting and/or antimicrobial activity
GIFSLVKGAAKLAGKGLAKEGGKFGLELIACKIAKQC

SEQ ID NO: 2025 - protein, 39 aa, Artificial
  Peptide with targeting and/or antimicrobial activity
GRKSDCFRKSGFCAFLKCPSLTLISGKCSRFYLCCKRIW

SEQ ID NO: 2026 - protein, 39 aa, Artificial
  Peptide with targeting and/or antimicrobial activity
GRKSDCFRKNGFCAFLKCPYLTLISGKCSRFHLCCKRIW

SEQ ID NO: 2027 - protein, 36 aa, Artificial
  Peptide with targeting and/or antimicrobial activity
LFCKGGSCHFGGCPSHLIKVGSCFGFRSCCKWPWNA

SEQ ID NO: 2028 - protein, 40 aa, Artificial
  Peptide with targeting and/or antimicrobial activity
VRNHVTCRINRGFCVPIRCPGRTRQIGTCFGPRIKCCRSW

SEQ ID NO: 2029 - protein, 42 aa, Artificial
  Peptide with targeting and/or antimicrobial activity
QGVRNHVTCRINRGFCVPIRCPGRTRQIGTCFGPRIKCCRSW

SEQ ID NO: 2030 - protein, 41 aa, Artificial
  Peptide with targeting and/or antimicrobial activity
QRVRNPQSCRWNMGVCIPFLCRVGMRQIGTCFGPRVPCCRR

SEQ ID NO: 2031 - protein, 42 aa, Artificial
  Peptide with targeting and/or antimicrobial activity
QVVRNPQSCRWNMGVCIPISCPGNMRQIGTCFGPRVPCCRRW

SEQ ID NO: 2032 - protein, 42 aa, Artificial
  Peptide with targeting and/or antimicrobial activity
QGVRNHVTCRIYGGFCVPIRCPGRTRQIGTCFGRPVKCCRRW

SEQ ID NO: 2033 - protein, 40 aa, Artificial
  Peptide with targeting and/or antimicrobial activity
QGVRNFVTCRINRGFCVPIRCPGHRRQIGTCLGPRIKCCR

SEQ ID NO: 2034 - protein, 38 aa, Artificial
  Peptide with targeting and/or antimicrobial activity
VRNFVTCRINRGFCVPIRCPGHRRQIGTCLGPQIKCCR

SEQ ID NO: 2035 - protein, 40 aa, Artificial
  Peptide with targeting and/or antimicrobial activity
QGVRNFVTCRINRGFCVPIRCPGHRRQIGTCLAPQIKCCR

SEQ ID NO: 2036 - protein, 40 aa, Artificial
  Peptide with targeting and/or antimicrobial activity
QGVRSYLSCWGNRGICLLNRCPGRMRQIGTCLAPRVKCCR

SEQ ID NO: 2037 - protein, 38 aa, Artificial
  Peptide with targeting and/or antimicrobial activity
GPLSCRRNGGVCIPIRCPGPMRQIGTCFGRPVKCCRSW

SEQ ID NO: 2038 - protein, 42 aa, Artificial
  Peptide with targeting and/or antimicrobial activity
SGISGPLSCGRNGGVCIPIRCPVPMRQIGTCFGRPVKCCRSW

SEQ ID NO: 2039 - protein, 37 aa, Artificial
  Peptide with targeting and/or antimicrobial activity
PWNIFKEIERAVARTRDAVISAGPAVRTVAAATSVAS

SEQ ID NO: 2040 - protein, 30 aa, Artificial
  Peptide with targeting and/or antimicrobial activity
RCICTTRTCRFPYRRLGTCLFQNRVYTFCC

SEQ ID NO: 2041 - protein, 23 aa, Artificial
  Peptide with targeting and/or antimicrobial activity
RIIDLLWRVRRPQKPKFVTVWVR

SEQ ID NO: 2042 - protein, 37 aa, Artificial
  Peptide with targeting and/or antimicrobial activity
VGRFRRLRKKTRKRLKKIGKVLKWIPPIVGSIPLGCG

SEQ ID NO: 2043 - protein, 37 aa, Artificial
  Peptide with targeting and/or antimicrobial activity
GLLSRLRDFLSDRGRRLGEKIERIGQKIKDLSEFFQS

SEQ ID NO: 2044 - protein, 18 aa, Artificial
  Peptide with targeting and/or antimicrobial activity
RGGRLCYCRGWICFCVGR

SEQ ID NO: 2045 - protein, 18 aa, Artificial
  Peptide with targeting and/or antimicrobial activity
RGGRLCYCRPRFCVCVGR

SEQ ID NO: 2046 - protein, 35 aa, Artificial
  Peptide with targeting and/or antimicrobial activity
RWKIFKKIERVGQNVRDGIIKAGPAIQVLGTAKAL

SEQ ID NO: 2047 - protein, 35 aa, Artificial
  Peptide with targeting and/or antimicrobial activity
RWKFFKKIERVGQNVRDGLIKAGPAIQVLGAAKAL

SEQ ID NO: 2048 - protein, 35 aa, Artificial
  Peptide with targeting and/or antimicrobial activity
RWKVFKKIEKVGRNIRDGVIKAGPAIAVVGQAKAL

SEQ ID NO: 2049 - protein, 35 aa, Artificial
  Peptide with targeting and/or antimicrobial activity
RWKVFKKIEKVGRHIRDGVIKAGPAITVVGQATAL

SEQ ID NO: 2050 - protein, 34 aa, Artificial
  Peptide with targeting and/or antimicrobial activity
GLLRKGGEKIGEKLKKIGQKIKNFFQKLVPQPEQ

SEQ ID NO: 2051 - protein, 27 aa, Artificial
  Peptide with targeting and/or antimicrobial activity
GRFKRFRKKFKKLFKKLSPVIPLLHLG

SEQ ID NO: 2052 - protein, 28 aa, Artificial
  Peptide with targeting and/or antimicrobial activity
GGLRSLGRKILRAWKKYGPIIVPIIRIG

SEQ ID NO: 2053 - protein, 12 aa, Artificial
  Peptide with targeting and/or antimicrobial activity
RICRIIFLRVCR

SEQ ID NO: 2054 - protein, 32 aa, Artificial
  Peptide with targeting and/or antimicrobial activity
DLRFLYPRGKLPVPTPPPFNPKPIYIDMGNRY

SEQ ID NO: 2055 - protein, 32 aa, Artificial
  Peptide with targeting and/or antimicrobial activity
DLRFLYPRGKLPVPTLPPFNPKPIYIDMGNRY

SEQ ID NO: 2056 - protein, 39 aa, Artificial
  Peptide with targeting and/or antimicrobial activity
AGRGKQGGKVRAKAKTRSSRAGLQFPVGRVHRLLRKGNY

SEQ ID NO: 2057 - protein, 21 aa, Artificial
  Peptide with targeting and/or antimicrobial activity
TRSSRAGLQFPVGRVHRLLRK

SEQ ID NO: 2058 - protein, 25 aa, Artificial
  Peptide with targeting and/or antimicrobial activity
GLLSVLGSVAKHVLPHVVPVIAEHL

SEQ ID NO: 2059 - protein, 25 aa, Artificial
  Peptide with targeting and/or antimicrobial activity
GLLGVLGSVAKHVLPHVVPVIAEHL

SEQ ID NO: 2060 - protein, 25 aa, Artificial
  Peptide with targeting and/or antimicrobial activity
GLLSVLGSVAQHVLPHVVPVIAEHL

SEQ ID NO: 2061 - protein, 25 aa, Artificial
  Peptide with targeting and/or antimicrobial activity
GLLSSLSSVAKHVLPHVVPVIAEHL

SEQ ID NO: 2062 - protein, 25 aa, Artificial
  Peptide with targeting and/or antimicrobial activity
GLLSVLGSVVKHVIPHVVPVIAEHL

SEQ ID NO: 2063 - protein, 24 aa, Artificial
  Peptide with targeting and/or antimicrobial activity
GLFSVLGAVAKHVLPHVVPVIAEK

SEQ ID NO: 2064 - protein, 24 aa, Artificial
  Peptide with targeting and/or antimicrobial activity
GLFKVLGSVAKHLLPHVAPVIAEK

SEQ ID NO: 2065 - protein, 25 aa, Artificial
  Peptide with targeting and/or antimicrobial activity
GLVSSIGRALGGLLADVVKSKGQPA

SEQ ID NO: 2066 - protein, 25 aa, Artificial
  Peptide with targeting and/or antimicrobial activity
GLVSSIGRALGGLLADVVKSKEQPA

SEQ ID NO: 2067 - protein, 25 aa, Artificial
  Peptide with targeting and/or antimicrobial activity
GLVSSIGKALGGLLADVVKTKEQPA

SEQ ID NO: 2068 - protein, 25 aa, Artificial
  Peptide with targeting and/or antimicrobial activity
GLVSSIGRALGGLLADVVKSKEQPA

SEQ ID NO: 2069 - protein, 22 aa, Artificial
  Peptide with targeting and/or antimicrobial activity
GLWQKIKDKASELVSGIVEGVK

SEQ ID NO: 2070 - protein, 22 aa, Artificial
  Peptide with targeting and/or antimicrobial activity
GLWEKIKEKASELVSGIVEGVK

SEQ ID NO: 2071 - protein, 22 aa, Artificial
  Peptide with targeting and/or antimicrobial activity
GLWEKIKEKANELVSGIVEGVK

SEQ ID NO: 2072 - protein, 22 aa, Artificial
  Peptide with targeting and/or antimicrobial activity
GLWEKIREKANELVSGIVEGVK

SEQ ID NO: 2073 - protein, 23 aa, Artificial
  Peptide with targeting and/or antimicrobial activity
GLWQKIKSAAGDLASGIVEGIKS

SEQ ID NO: 2074 - protein, 23 aa, Artificial
  Peptide with targeting and/or antimicrobial activity
GLWQKIKSAAGDLASGIVEAIKS

SEQ ID NO: 2075 - protein, 23 aa, Artificial
  Peptide with targeting and/or antimicrobial activity
GLWQKIKNAAGDLASGIVEGIKS

SEQ ID NO: 2076 - protein, 20 aa, Artificial
  Peptide with targeting and/or antimicrobial activity
GLMSVLGHAVGNVLGGLFKS

SEQ ID NO: 2077 - protein, 37 aa, Artificial
  Peptide with targeting and/or antimicrobial activity
DQYKCLQHGGFCLRSSCPSNTKLQGTCKPDKPNCCKS

SEQ ID NO: 2078 - protein, 34 aa, Artificial
  Peptide with targeting and/or antimicrobial activity
GLFRRLRDSIRRGQQKILEKARRIGERIKDIFRG

SEQ ID NO: 2079 - protein, 34 aa, Artificial
  Peptide with targeting and/or antimicrobial activity
SIVPIRCRSNRDCRRFCGFRGGRCTYARQCLCGY

SEQ ID NO: 2080 - protein, 31 aa, Artificial
  Peptide with targeting and/or antimicrobial activity
SIPCGESCVFIPCTVTALLGCSCKSKVCYKN

SEQ ID NO: 2081 - protein, 13 aa, Artificial
  Peptide with targeting and/or antimicrobial activity
FLPLIGRVLSGIL

SEQ ID NO: 2082 - protein, 13 aa, Artificial
  Peptide with targeting and/or antimicrobial activity
LLPILGNLLNGLL

SEQ ID NO: 2083 - protein, 13 aa, Artificial
  Peptide with targeting and/or antimicrobial activity
VLPIIGNLLNSLL

SEQ ID NO: 2084 - protein, 13 aa, Artificial
  Peptide with targeting and/or antimicrobial activity
FLPLIGKVLSGIL

SEQ ID NO: 2085 - protein, 10 aa, Artificial
  Peptide with targeting and/or antimicrobial activity
LLPNLLKSLL

SEQ ID NO: 2086 - protein, 46 aa, Artificial
  Peptide with targeting and/or antimicrobial activity
EVERKHPLGGSRPGRCPTVPPGTFGHCACLCTGDASEPKGQKCCSN

SEQ ID NO: 2087 - protein, 13 aa, Artificial
  Peptide with targeting and/or antimicrobial activity
FVQWFSKFLGRIL

SEQ ID NO: 2088 - protein, 13 aa, Artificial
  Peptide with targeting and/or antimicrobial activity
LLPIVGNLLKSLL

SEQ ID NO: 2089 - protein, 13 aa, Artificial
  Peptide with targeting and/or antimicrobial activity
FFPVIGRILNGIL

SEQ ID NO: 2090 - protein, 74 aa, Artificial
  Peptide with targeting and/or antimicrobial activity
SLQGGAPNFPQPSQQNGGWQVSPDLGRDDKGNTRGQIEIQNKGKDHDFNAGWGKVIRGPNKAKPTWHVGGTYRR

SEQ ID NO: 2091 - protein, 39 aa, Artificial
  Peptide with targeting and/or antimicrobial activity
RRRPRPPYLPRPRPPPFFPPRLPPRIPPGFPPRFPPRFP

SEQ ID NO: 2092 - protein, 38 aa, Artificial
  Peptide with targeting and/or antimicrobial activity
GFGCPLDQMQCHRHCQTITGRSGGYCSGPLKLTCTCYR

SEQ ID NO: 2093 - protein, 34 aa, Artificial
  Peptide with targeting and/or antimicrobial activity
GICACRRRFCLNFEQFSGYCRVNGARYVRCCSRR

SEQ ID NO: 2094 - protein, 32 aa, Artificial
  Peptide with targeting and/or antimicrobial activity
RADTQTYQPYNKDWIKEKIYVLLRRQAQQAGK

SEQ ID NO: 2095 - protein, 34 aa, Artificial
  Peptide with targeting and/or antimicrobial activity
ALWKTMLKKLGTMALHAGKAALGAAADTISQGTQ

SEQ ID NO: 2096 - protein, 34 aa, Artificial
  Peptide with targeting and/or antimicrobial activity
ALWFTMLKKLGTMALHAGKAALGAAANTISQGTQ

SEQ ID NO: 2097 - protein, 30 aa, Artificial
  Peptide with targeting and/or antimicrobial activity
ALWKNMLKGIGKLAGKAALGAVKKLVGAES

SEQ ID NO: 2098 - protein, 27 aa, Artificial
  Peptide with targeting and/or antimicrobial activity
ALWMTLLKKVLKAAAKALNAVLVGANA

SEQ ID NO: 2099 - protein, 29 aa, Artificial
  Peptide with targeting and/or antimicrobial activity
GLWSKIKTAGKSVAKAAAKAAVKAVTNAV

SEQ ID NO: 2100 - protein, 31 aa, Artificial
  Peptide with targeting and/or antimicrobial activity
AMWKDVLKKIGTVALHAGKAALGAVADTISQ

SEQ ID NO: 2101 - protein, 39 aa, Artificial
  Peptide with targeting and/or antimicrobial activity
GRKSDCFRKSGFCAFLKCPSLTLISGKCSRFYLCCKRIR

SEQ ID NO: 2102 - protein, 33 aa, Artificial
  Peptide with targeting and/or antimicrobial activity
GRKSDCFRKNGFCAFLKCPYLTLISGLCSFHLC

SEQ ID NO: 2103 - protein, 35 aa, Artificial
  Peptide with targeting and/or antimicrobial activity
GKREKCLRRNGFCAFLKCPTLSVISGTCSRFQVCC

SEQ ID NO: 2104 - protein, 36 aa, Artificial
  Peptide with targeting and/or antimicrobial activity
LFCKRGTCHFGRCPSHLIKVGSCFGFRSCCKWPWDA

SEQ ID NO: 2105 - protein, 25 aa, Artificial
  Peptide with targeting and/or antimicrobial activity
LSCKRGTCHFGRCPSHLIKGSCSGG

SEQ ID NO: 2106 - protein, 33 aa, Artificial
  Peptide with targeting and/or antimicrobial activity
SLFSLIKAGAKFLGKNLLKQGACYAACKASKQC

SEQ ID NO: 2107 - protein, 33 aa, Artificial
  Peptide with targeting and/or antimicrobial activity
GIMSIVKDVAKNAAKEAAKGALSTLSCKLAKTC

SEQ ID NO: 2108 - protein, 33 aa, Artificial
  Peptide with targeting and/or antimicrobial activity
GIMSIVKDVAKTAAKEAAKGALSTLSCKLAKTC

SEQ ID NO: 2109 - protein, 24 aa, Artificial
  Peptide with targeting and/or antimicrobial activity
FLGALFKVASKVLPSVFCAITKKC

SEQ ID NO: 2110 - protein, 24 aa, Artificial
  Peptide with targeting and/or antimicrobial activity
FLPLLAGLAANFLPTIICKISYKC

SEQ ID NO: 2111 - protein, 15 aa, Artificial
  Peptide with targeting and/or antimicrobial activity
VDKPDYRPRPRPPNM

SEQ ID NO: 2112 - protein, 15 aa, Artificial
  Peptide with targeting and/or antimicrobial activity
VDKPDYRPRPWPRPN

SEQ ID NO: 2113 - protein, 16 aa, Artificial
  Peptide with targeting and/or antimicrobial activity
VDKPDYRPRPWPRNMI

SEQ ID NO: 2114 - protein, 16 aa, Artificial
  Peptide with targeting and/or antimicrobial activity
VDKPDYRPRPWPRPNM

SEQ ID NO: 2115 - protein, 44 aa, Artificial
  Peptide with targeting and/or antimicrobial activity
KYYGNGVSCNKNGCTVDWSKAIGIIGNNAAANLTTGGAAGWNKG

SEQ ID NO: 2116 - protein, 22 aa, Artificial
  Peptide with targeting and/or antimicrobial activity
FKSWSFCTPGCAKTGSFNSYCC

SEQ ID NO: 2117 - protein, 23 aa, Artificial
  Peptide with targeting and/or antimicrobial activity
VFQFLGKIIHHVGNFVHGFSHVF

SEQ ID NO: 2118 - protein, 23 aa, Artificial
  Peptide with targeting and/or antimicrobial activity
VFQFLGRIIHHVGNFVHGFSHVF

SEQ ID NO: 2119 - protein, 23 aa, Artificial
  Peptide with targeting and/or antimicrobial activity
VFHLLGKIIHHVGNFVYGFSHVF

SEQ ID NO: 2120 - protein, 23 aa, Artificial
  Peptide with targeting and/or antimicrobial activity
AFKLLGRIIHHVGNFVYGFSHVF

SEQ ID NO: 2121 - protein, 23 aa, Artificial
  Peptide with targeting and/or antimicrobial activity
LFKLLGKIIHHVGNFVHGFSHVF

SEQ ID NO: 2122 - protein, 44 aa, Artificial
  Peptide with targeting and/or antimicrobial activity
DVQCGEGHFCHDQTCCRASQGGACCPYSQGVCCADQRHCCPVGF

SEQ ID NO: 2123 - protein, 36 aa, Artificial
  Peptide with targeting and/or antimicrobial activity
YPPKPESPGEDASPEEMNKYLTALRHYINLVTRQRY

SEQ ID NO: 2124 - protein, 33 aa, Artificial
  Peptide with targeting and/or antimicrobial activity
GLLNTFKDWAISIAKGAGKGVLTTLSCKLDKSC

SEQ ID NO: 2125 - protein, 33 aa, Artificial
  Peptide with targeting and/or antimicrobial activity
SLFSLIKAGAKFLGKNLLKQGAQYAACKVSKEC

SEQ ID NO: 2126 - protein, 37 aa, Artificial
  Peptide with targeting and/or antimicrobial activity
GILDSFKQFAKGVGKDLIKGAAQGVLSTMSCKLAKTC

SEQ ID NO: 2127 - protein, 50 aa, Artificial
  Peptide with targeting and/or antimicrobial activity
YRGGYTGPIPRPPPIGRPPLRLVVCACYRLSVSDARNCCIKFGSCCHLVK

SEQ ID NO: 2128 - protein, 50 aa, Artificial
  Peptide with targeting and/or antimicrobial activity
YRGGYTGPIPRPPPIGRPPFRPVCNACYRLSVSDARNCCIKFGSCCHLVK

SEQ ID NO: 2129 - protein, 62 aa, Artificial
  Peptide with targeting and/or antimicrobial activity
QVYKGGYTRPIPRPPPFVRPLPGGPIGPYNGCPVSCRGISFSQARSCCSRLGRCCHVGKGYS

SEQ ID NO: 2130 - protein, 24 aa, Artificial
  Peptide with targeting and/or antimicrobial activity
GLFKVLGSVAKHLLPHVVPVIAEK

SEQ ID NO: 2131 - protein, 24 aa, Artificial
  Peptide with targeting and/or antimicrobial activity
GLFGVLGSIAKHVLPHVVPVIAEK

SEQ ID NO: 2132 - protein, 35 aa, Artificial
  Peptide with targeting and/or antimicrobial activity
GGLKKLGKKLEGVGKRVFKASEKALPVAVGIKALG

SEQ ID NO: 2133 - protein, 16 aa, Artificial
  Peptide with targeting and/or antimicrobial activity
GRPNPVNTKPTPYPRL

SEQ ID NO: 2134 - protein, 16 aa, Artificial
  Peptide with targeting and/or antimicrobial activity
GRPNPVNNKPTPHPRL

SEQ ID NO: 2135 - protein, 47 aa, Artificial
  Peptide with targeting and/or antimicrobial activity
LLGRCKVKSNRFHGPCLTDTHCSTVCRGEGYKGGDCHGLRRRCMCLC

SEQ ID NO: 2136 - protein, 47 aa, Artificial
  Peptide with targeting and/or antimicrobial activity
LLGRCKVKSNRFNGPCLTDTHCSTVCRGEGYKGGDCHGLRRRCMCLC

SEQ ID NO: 2137 - protein, 39 aa, Artificial
  Peptide with targeting and/or antimicrobial activity
FVPYNPPRPYQSKPFPSFPGHGPFNPKIQWPYPLPNPGH

SEQ ID NO: 2138 - protein, 17 aa, Artificial
  Peptide with targeting and/or antimicrobial activity
GNRPVYIPPPRPPHPRL

SEQ ID NO: 2139 - protein, 33 aa, Artificial
  Peptide with targeting and/or antimicrobial activity
VTCFCRRRGCASRERHIGYCRFGNTIYRLCCRR

SEQ ID NO: 2140 - protein, 31 aa, Artificial
  Peptide with targeting and/or antimicrobial activity
CFCKRPVCDSGETQIGYCRLGNTFYRLCCRQ

SEQ ID NO: 2141 - protein, 33 aa, Artificial
  Peptide with targeting and/or antimicrobial activity
VTCFCRRRGCASRERLIGYCRFGNTIYGLCCRR

SEQ ID NO: 2142 - protein, 33 aa, Artificial
  Peptide with targeting and/or antimicrobial activity
VTCFCKRPVCDSGETQIGYCRLGNTFYRLCCRQ

SEQ ID NO: 2143 - protein, 19 aa, Artificial
  Peptide with targeting and/or antimicrobial activity
GFGKAFHSVSNFAKKHKTA

SEQ ID NO: 2144 - protein, 19 aa, Artificial
  Peptide with targeting and/or antimicrobial activity
GFGPAFHSVSNFAKKHKTA

SEQ ID NO: 2145 - protein, 21 aa, Artificial
  Peptide with targeting and/or antimicrobial activity
RQRVEELSKFSKKGAAARRRK

SEQ ID NO: 2146 - protein, 29 aa, Artificial
  Peptide with targeting and/or antimicrobial activity
ALWKNMLKGIGKLAGQAALGAVKTLVGAE

SEQ ID NO: 2147 - protein, 28 aa, Artificial
  Peptide with targeting and/or antimicrobial activity
ALWKDILKNVGKAAGKAVLNTVTDMVNQ

SEQ ID NO: 2148 - protein, 26 aa, Artificial
  Peptide with targeting and/or antimicrobial activity
GLWNKIKEAASKAAGKAALGFVNEMV

SEQ ID NO: 2149 - protein, 30 aa, Artificial
  Peptide with targeting and/or antimicrobial activity
ALWKTIIKGAGKMIGSLAKNLLGSQAQPES

SEQ ID NO: 2150 - protein, 19 aa, Artificial
  Peptide with targeting and/or antimicrobial activity
GWMSKIASGIGTFLSGMQQ

SEQ ID NO: 2151 - protein, 24 aa, Artificial
  Peptide with targeting and/or antimicrobial activity
MFFSSKKCKTVSKTFRGPCVRNAN

SEQ ID NO: 2152 - protein, 23 aa, Artificial
  Peptide with targeting and/or antimicrobial activity
MFFSSKKCKTVSKTFRGPCVRNA

SEQ ID NO: 2153 - protein, 25 aa, Artificial
  Peptide with targeting and/or antimicrobial activity
GIFSSRKCKTVSKTFRGICTRNANC

SEQ ID NO: 2154 - protein, 21 aa, Artificial
  Peptide with targeting and/or antimicrobial activity
TCESPSHKFKGPCATNRNCES

SEQ ID NO: 2155 - protein, 38 aa, Artificial
  Peptide with targeting and/or antimicrobial activity
GIFSSRKCKTPSKTFKGYCTRDSNCDTSCRYEGYPAGD

SEQ ID NO: 2156 - protein, 41 aa, Artificial
  Peptide with targeting and/or antimicrobial activity
QQCGRQASGRLCGNRLCCSQWGYCGSTASYCGAGCQSQCRS

SEQ ID NO: 2157 - protein, 71 aa, Artificial
  Peptide with targeting and/or antimicrobial activity
SLQPGAPNVNNKDQPWQVSPHISRDDSGNTRTDINVQRHGENNDFEAGWSKVVRGPNKAKPTWHIGGTHRW

SEQ ID NO: 2158 - protein, 47 aa, Artificial
  Peptide with targeting and/or antimicrobial activity
SSLLEKGLDGAKKAVGGLGKLGKDAVEDLESVGKGAVHDVKDVLDSV

SEQ ID NO: 2159 - protein, 34 aa, Artificial
  Peptide with targeting and/or antimicrobial activity
GCASRCKAKCAGRRCKGWASASFRGRCYCKCFRC

SEQ ID NO: 2160 - protein, 34 aa, Artificial
  Peptide with targeting and/or antimicrobial activity
SCASRCKGHCRARRCGYYVSVLYRGRCYCKCLRC

SEQ ID NO: 2161 - protein, 22 aa, Artificial
  Peptide with targeting and/or antimicrobial activity
FFHHIFRGIVHVGKTIHKLVTG

SEQ ID NO: 2162 - protein, 16 aa, Artificial
  Peptide with targeting and/or antimicrobial activity
GLFDVIKKVASVIGGL

SEQ ID NO: 2163 - protein, 16 aa, Artificial
  Peptide with targeting and/or antimicrobial activity
GLFDIIKKVASVVGGL

SEQ ID NO: 2164 - protein, 16 aa, Artificial
  Peptide with targeting and/or antimicrobial activity
GLFDIIKKVASVIGGL

SEQ ID NO: 2165 - protein, 19 aa, Artificial
  Peptide with targeting and/or antimicrobial activity
PDPAKTAPKKGSKKAVTKA

SEQ ID NO: 2166 - protein, 43 aa, Artificial
  Peptide with targeting and/or antimicrobial activity
RFRPPIRRPPIRPPFNPPFRPPVRPPFRPPFRPPFRPPIGPFP

SEQ ID NO: 2167 - protein, 19 aa, Artificial
  Peptide with targeting and/or antimicrobial activity
GIVDFAKKVVGGIRNALGI

SEQ ID NO: 2168 - protein, 19 aa, Artificial
  Peptide with targeting and/or antimicrobial activity
GFVDLAKKVVGGIRNALGI

SEQ ID NO: 2169 - protein, 19 aa, Artificial
  Peptide with targeting and/or antimicrobial activity
GFFDLAKKVVGGIRNALGI

SEQ ID NO: 2170 - protein, 19 aa, Artificial
  Peptide with targeting and/or antimicrobial activity
GILDFAKTVVGGIRNALGI

SEQ ID NO: 2171 - protein, 19 aa, Artificial
  Peptide with targeting and/or antimicrobial activity
GIVDFAKGVLGKIKNVLGI

SEQ ID NO: 2172 - protein, 17 aa, Artificial
  Peptide with targeting and/or antimicrobial activity
GVLDAFRKIATVVKNVV

SEQ ID NO: 2173 - protein, 17 aa, Artificial
  Peptide with targeting and/or antimicrobial activity
GVGSFIHKVVSAIKNVA

SEQ ID NO: 2174 - protein, 19 aa, Artificial
  Peptide with targeting and/or antimicrobial activity
GIIDIAKKLVGGIRNVLGI

SEQ ID NO: 2175 - protein, 19 aa, Artificial
  Peptide with targeting and/or antimicrobial activity
GILDVAKTLVGKLRNVLGI

SEQ ID NO: 2176 - protein, 17 aa, Artificial
  Peptide with targeting and/or antimicrobial activity
GVGDLIRKAVSVIKNIV

SEQ ID NO: 2177 - protein, 17 aa, Artificial
  Peptide with targeting and/or antimicrobial activity
GVIDAAKKVVNVLKNLP

SEQ ID NO: 2178 - protein, 13 aa, Artificial
  Peptide with targeting and/or antimicrobial activity
GWFDVVKHIASAV

SEQ ID NO: 2179 - protein, 22 aa, Artificial
  Peptide with targeting and/or antimicrobial activity
GLFVGVLAKVAAHVVPAIAEHF

SEQ ID NO: 2180 - protein, 23 aa, Artificial
  Peptide with targeting and/or antimicrobial activity
GLFVGLAKVAAHNNPAIAEHFQA

SEQ ID NO: 2181 - protein, 18 aa, Artificial
  Peptide with targeting and/or antimicrobial activity
GFVDFLKKVAGTIANVVT

SEQ ID NO: 2182 - protein, 26 aa, Artificial
  Peptide with targeting and/or antimicrobial activity
GLLQTIKEKLESLESLAKGIVSGIQA

SEQ ID NO: 2183 - protein, 25 aa, Artificial
  Peptide with targeting and/or antimicrobial activity
GLLSVLGSVAKHVLPHVVPVIAEKL

SEQ ID NO: 2184 - protein, 20 aa, Artificial
  Peptide with targeting and/or antimicrobial activity
VNPIILGVLPKFVCLITKKC

SEQ ID NO: 2185 - protein, 17 aa, Artificial
  Peptide with targeting and/or antimicrobial activity
FITLLLRKFICSITKKC

SEQ ID NO: 2186 - protein, 29 aa, Artificial
  Peptide with targeting and/or antimicrobial activity
GLWETIKNFGKKFTLNILHKLKCKIGGGC

SEQ ID NO: 2187 - protein, 29 aa, Artificial
  Peptide with targeting and/or antimicrobial activity
GLWETIKNFGKKFTLNILHNLKCKIGGGC

SEQ ID NO: 2188 - protein, 13 aa, Artificial
  Peptide with targeting and/or antimicrobial activity
SGFVLKGYTKTSQ

SEQ ID NO: 2189 - protein, 13 aa, Artificial
  Peptide with targeting and/or antimicrobial activity
AGFVLKGYTKTSQ

SEQ ID NO: 2190 - protein, 20 aa, Artificial
  Peptide with targeting and/or antimicrobial activity
IIGPVLGMVGSALGGLLKKI

SEQ ID NO: 2191 - protein, 20 aa, Artificial
  Peptide with targeting and/or antimicrobial activity
LIGPVLGLVGSALGGLLKKI

SEQ ID NO: 2192 - protein, 20 aa, Artificial
  Peptide with targeting and/or antimicrobial activity
IIGPVLGLVGSALGGLLKKI

SEQ ID NO: 2193 - protein, 27 aa, Artificial
  Peptide with targeting and/or antimicrobial activity
GIGASILSAGKSALKGFAKGLAEHFAN

SEQ ID NO: 2194 - protein, 35 aa, Artificial
  Peptide with targeting and/or antimicrobial activity
LRDLVCYCRTRGCKRRERMNGTCRKGHLMYTLCCR

SEQ ID NO: 2195 - protein, 30 aa, Artificial
  Peptide with targeting and/or antimicrobial activity
ACYCRIPACLAGERRYGTCFYMGRVWAFCC

SEQ ID NO: 2196 - protein, 13 aa, Artificial
  Peptide with targeting and/or antimicrobial activity
GLFDIIKKIAESI

SEQ ID NO: 2197 - protein, 16 aa, Artificial
  Peptide with targeting and/or antimicrobial activity
GLLDIVKKVVGAFGSL

SEQ ID NO: 2198 - protein, 16 aa, Artificial
  Peptide with targeting and/or antimicrobial activity
GLFDIVKKVVGALGSL

SEQ ID NO: 2199 - protein, 16 aa, Artificial
  Peptide with targeting and/or antimicrobial activity
GLFDIVKKVVGAIGSL

SEQ ID NO: 2200 - protein, 16 aa, Artificial
  Peptide with targeting and/or antimicrobial activity
GLFDIVKKVVGTIAGL

SEQ ID NO: 2201 - protein, 16 aa, Artificial
  Peptide with targeting and/or antimicrobial activity
GLFDIVKKVVGAFGSL

SEQ ID NO: 2202 - protein, 16 aa, Artificial
  Peptide with targeting and/or antimicrobial activity
GLFDIAKKVIGVIGSL

SEQ ID NO: 2203 - protein, 17 aa, Artificial
  Peptide with targeting and/or antimicrobial activity
GLFDIVKKIAGHIAGSI

SEQ ID NO: 2204 - protein, 17 aa, Artificial
  Peptide with targeting and/or antimicrobial activity
GLFDIVKKIAGHIASSI

SEQ ID NO: 2205 - protein, 17 aa, Artificial
  Peptide with targeting and/or antimicrobial activity
GLFDIVKKIAGHIVSSI

SEQ ID NO: 2206 - protein, 30 aa, Artificial
  Peptide with targeting and/or antimicrobial activity
GWKDWAKKAGGWLKKKGPGMAKAALKAAMQ

SEQ ID NO: 2207 - protein, 30 aa, Artificial
  Peptide with targeting and/or antimicrobial activity
GWKDWLKKGKEWLKAKGPGIVKAALQAATQ

SEQ ID NO: 2208 - protein, 30 aa, Artificial
  Peptide with targeting and/or antimicrobial activity
GWKDWLNKGKEWLKKKGPGIMKAALKAATQ

SEQ ID NO: 2209 - protein, 29 aa, Artificial
  Peptide with targeting and/or antimicrobial activity
DFKDWMKTAGEWLKKKGPGILKAAMAAAT

SEQ ID NO: 2210 - protein, 30 aa, Artificial
  Peptide with targeting and/or antimicrobial activity
GLKDWVKIAGGWLKKKGPGILKAAMAAATQ

SEQ ID NO: 2211 - protein, 18 aa, Artificial
  Peptide with targeting and/or antimicrobial activity
GLVDVLGKVGGLIKKLLP

SEQ ID NO: 2212 - protein, 19 aa, Artificial
  Peptide with targeting and/or antimicrobial activity
GLVDVLGKVGGLIKKLLPG

SEQ ID NO: 2213 - protein, 24 aa, Artificial
  Peptide with targeting and/or antimicrobial activity
LLKELWTKMKGAGKAVLGKIKGLL

SEQ ID NO: 2214 - protein, 24 aa, Artificial
  Peptide with targeting and/or antimicrobial activity
LLKELWTKIKGAGKAVLGKIKGLL

SEQ ID NO: 2215 - protein, 25 aa, Artificial
  Peptide with targeting and/or antimicrobial activity
WLGSALKIGAKLLPSVVGLFKKKKQ

SEQ ID NO: 2216 - protein, 25 aa, Artificial
  Peptide with targeting and/or antimicrobial activity
WLGSALKIGAKLLPSVVGLFQKKKK

SEQ ID NO: 2217 - protein, 26 aa, Artificial
  Peptide with targeting and/or antimicrobial activity
GIWGTLAKIGIKAVPRVISMLKKKKQ

SEQ ID NO: 2218 - protein, 26 aa, Artificial
  Peptide with targeting and/or antimicrobial activity
GIWGTALKWGVKLLPKLVGMAQTKKQ

SEQ ID NO: 2219 - protein, 24 aa, Artificial
  Peptide with targeting and/or antimicrobial activity
FWGALIKGAAKLIPSVVGLFKKKQ

SEQ ID NO: 2220 - protein, 20 aa, Artificial
  Peptide with targeting and/or antimicrobial activity
FIGTALGIASAIPAIVKLFK

SEQ ID NO: 2221 - protein, 11 aa, Artificial
  Peptide with targeting and/or antimicrobial activity
FCTMIPIPRCY

SEQ ID NO: 2222 - protein, 12 aa, Artificial
  Peptide with targeting and/or antimicrobial activity
RVCFAIPLPICH

SEQ ID NO: 2223 - protein, 12 aa, Artificial
  Peptide with targeting and/or antimicrobial activity
RVCYAIPLPICY

SEQ ID NO: 2224 - protein, 41 aa, Artificial
  Peptide with targeting and/or antimicrobial activity
GILDTIKSIASKVWNSKTVQDLKRKGINWVANKLGVSPQAA

SEQ ID NO: 2225 - protein, 33 aa, Artificial
  Peptide with targeting and/or antimicrobial activity
GLLSGLKKVGKHVAKNVAVSLMDSLKCKISGDC

SEQ ID NO: 2226 - protein, 25 aa, Artificial
  Peptide with targeting and/or antimicrobial activity
SMLSVLKNLGKVGLGFVACKINKQC

SEQ ID NO: 2227 - protein, 31 aa, Artificial
  Peptide with targeting and/or antimicrobial activity
GLFLDTLKGAAKDVAGKLEGLKCKITGCKLP

SEQ ID NO: 2228 - protein, 32 aa, Artificial
  Peptide with targeting and/or antimicrobial activity
GFLDIINKLGKTFAGHMLDKIKCTIGTCPPSP

SEQ ID NO: 2229 - protein, 24 aa, Artificial
  Peptide with targeting and/or antimicrobial activity
FLPFIARLAAKVFPSIICSVTKKC

SEQ ID NO: 2230 - protein, 13 aa, Artificial
  Peptide with targeting and/or antimicrobial activity
FISAIASMLGKFL

SEQ ID NO: 2231 - protein, 13 aa, Artificial
  Peptide with targeting and/or antimicrobial activity
FLSAIASMLGKFL

SEQ ID NO: 2232 - protein, 13 aa, Artificial
  Peptide with targeting and/or antimicrobial activity
FISAIASFLGKFL

SEQ ID NO: 2233 - protein, 14 aa, Artificial
  Peptide with targeting and/or antimicrobial activity
FLFPLITSFLSKVL

SEQ ID NO: 2234 - protein, 24 aa, Artificial
  Peptide with targeting and/or antimicrobial activity
FLPMLAGLAASMVPKLVCLITKKC

SEQ ID NO: 2235 - protein, 24 aa, Artificial
  Peptide with targeting and/or antimicrobial activity
FLPMLAGLAASMVPKFVCLITKKC

SEQ ID NO: 2236 - protein, 32 aa, Artificial
  Peptide with targeting and/or antimicrobial activity
GILDSFKGVAKGVAKDLAGKLLDKLKCKITGC

SEQ ID NO: 2237 - protein, 32 aa, Artificial
  Peptide with targeting and/or antimicrobial activity
GILSSIKGVAKGVAKNVAAQLLDTLKCKITGC

SEQ ID NO: 2238 - protein, 13 aa, Artificial
  Peptide with targeting and/or antimicrobial activity
VLPLISMALGKLL

SEQ ID NO: 2239 - protein, 14 aa, Artificial
  Peptide with targeting and/or antimicrobial activity
NFLGTLINLAKKIM

SEQ ID NO: 2240 - protein, 14 aa, Artificial
  Peptide with targeting and/or antimicrobial activity
FLPILINLIHKGLL

SEQ ID NO: 2241 - protein, 24 aa, Artificial
  Peptide with targeting and/or antimicrobial activity
FLPFIAGMAAKFLPKIFCAISKKC

SEQ ID NO: 2242 - protein, 24 aa, Artificial
  Peptide with targeting and/or antimicrobial activity
FLPAIAGMAAKFLPKIFCAISKKC

SEQ ID NO: 2243 - protein, 24 aa, Artificial
  Peptide with targeting and/or antimicrobial activity
FLPFIAGVAAKFLPKIFCAISKKC

SEQ ID NO: 2244 - protein, 24 aa, Artificial
  Peptide with targeting and/or antimicrobial activity
FLPAIAGVAAKFLPKIFCAISKKC

SEQ ID NO: 2245 - protein, 24 aa, Artificial
  Peptide with targeting and/or antimicrobial activity
FLPAIVGAAAKFLPKIFCVISKKC

SEQ ID NO: 2246 - protein, 24 aa, Artificial
  Peptide with targeting and/or antimicrobial activity
FLPFIAGMAANFLPKIFCAISKKC

SEQ ID NO: 2247 - protein, 28 aa, Artificial
  Peptide with targeting and/or antimicrobial activity
GLLDTIKGVAKTVAASMLDKLKCKISGC

SEQ ID NO: 2248 - protein, 24 aa, Artificial
  Peptide with targeting and/or antimicrobial activity
FLPIIAGVAAKVFPKIFCAISKKC

SEQ ID NO: 2249 - protein, 24 aa, Artificial
  Peptide with targeting and/or antimicrobial activity
FLPIIAGIAAKVFPKIFCAISKKC

SEQ ID NO: 2250 - protein, 24 aa, Artificial
  Peptide with targeting and/or antimicrobial activity
FLPIIASVAAKVFSKIFCAISKKC

SEQ ID NO: 2251 - protein, 24 aa, Artificial
  Peptide with targeting and/or antimicrobial activity
FLPIIASVAANVFSKIFCAISKKC

SEQ ID NO: 2252 - protein, 24 aa, Artificial
  Peptide with targeting and/or antimicrobial activity
FLPIIASVAAKVFPKIFCAISKKC

SEQ ID NO: 2253 - protein, 28 aa, Artificial
  Peptide with targeting and/or antimicrobial activity
GLMDTVKNVAKNLAGHMLDKLKCKITGC

SEQ ID NO: 2254 - protein, 13 aa, Artificial
  Peptide with targeting and/or antimicrobial activity
FLPIVGKLLSGLL

SEQ ID NO: 2255 - protein, 24 aa, Artificial
  Peptide with targeting and/or antimicrobial activity
FLPVVAGLAAKVLPSIICAVTKKC

SEQ ID NO: 2256 - protein, 25 aa, Artificial
  Peptide with targeting and/or antimicrobial activity
SMLSVLKNLGKVGLGLVACKINKQC

SEQ ID NO: 2257 - protein, 20 aa, Artificial
  Peptide with targeting and/or antimicrobial activity
FLGGLMKAFPALICAVTKKC

SEQ ID NO: 2258 - protein, 20 aa, Artificial
  Peptide with targeting and/or antimicrobial activity
FLGGLMKAFPAIICAVTKKC

SEQ ID NO: 2259 - protein, 31 aa, Artificial
  Peptide with targeting and/or antimicrobial activity
GLFLDTLKGAAKDVAGKLLEGLKCKIAGCKP

SEQ ID NO: 2260 - protein, 27 aa, Artificial
  Peptide with targeting and/or antimicrobial activity
GLFLDTLKGLAGKLLQGLKCIKAGCKP

SEQ ID NO: 2261 - protein, 13 aa, Artificial
  Peptide with targeting and/or antimicrobial activity
FLPFLAKILTGVL

SEQ ID NO: 2262 - protein, 13 aa, Artificial
  Peptide with targeting and/or antimicrobial activity
FLPLFASLIGKLL

SEQ ID NO: 2263 - protein, 13 aa, Artificial
  Peptide with targeting and/or antimicrobial activity
FLPFLASLLTKVL

SEQ ID NO: 2264 - protein, 13 aa, Artificial
  Peptide with targeting and/or antimicrobial activity
FLPFLASLLSKVL

SEQ ID NO: 2265 - protein, 13 aa, Artificial
  Peptide with targeting and/or antimicrobial activity
FLPFLATLLSKVL

SEQ ID NO: 2266 - protein, 24 aa, Artificial
  Peptide with targeting and/or antimicrobial activity
FLPAIVGAAGQFLPKIFCAISKKC

SEQ ID NO: 2267 - protein, 24 aa, Artificial
  Peptide with targeting and/or antimicrobial activity
FLPAIVGAAGKFLPKIFCAISKKC

SEQ ID NO: 2268 - protein, 24 aa, Artificial
  Peptide with targeting and/or antimicrobial activity
FFPIVAGVAGQVLKKIYCTISKKC

SEQ ID NO: 2269 - protein, 12 aa, Artificial
  Peptide with targeting and/or antimicrobial activity
ISLEICAIFHDN

SEQ ID NO: 2270 - protein, 21 aa, Artificial
  Peptide with targeting and/or antimicrobial activity
GCRFCCNCCPNMSGCGVCCRF

SEQ ID NO: 2271 - protein, 27 aa, Artificial
  Peptide with targeting and/or antimicrobial activity
GIGTKILGGVKTALKGALKELASTYAN

SEQ ID NO: 2272 - protein, 27 aa, Artificial
  Peptide with targeting and/or antimicrobial activity
GIGTKILGGVKTALKGALKELASTYVN

SEQ ID NO: 2273 - protein, 27 aa, Artificial
  Peptide with targeting and/or antimicrobial activity
GIGGKILSGLKTALKGAAKELASTYLH

SEQ ID NO: 2274 - protein, 27 aa, Artificial
  Peptide with targeting and/or antimicrobial activity
GIGGVLLSAGKAALKGLAKVLAEKYAN

SEQ ID NO: 2275 - protein, 27 aa, Artificial
  Peptide with targeting and/or antimicrobial activity
SIGAKILGGVKTFFKGALKELASTYLQ

SEQ ID NO: 2276 - protein, 20 aa, Artificial
  Peptide with targeting and/or antimicrobial activity
ILGPVISTIGGVLGGLLKNL

SEQ ID NO: 2277 - protein, 20 aa, Artificial
  Peptide with targeting and/or antimicrobial activity
ILGPVLGLVGNALGGLIKNE

SEQ ID NO: 2278 - protein, 20 aa, Artificial
  Peptide with targeting and/or antimicrobial activity
ILGPVLSLVGNALGGLLKNE

SEQ ID NO: 2279 - protein, 40 aa, Artificial
  Peptide with targeting and/or antimicrobial activity
ANTAFVSSAHNTQKIPAGAPFNRNLRAMLADLRQNAAFAG

SEQ ID NO: 2280 - protein, 24 aa, Artificial
  Peptide with targeting and/or antimicrobial activity
GLNTLKKVFQGLHEAIKLINNHVQ

SEQ ID NO: 2281 - protein, 24 aa, Artificial
  Peptide with targeting and/or antimicrobial activity
GLNALKKVFQGIHEAIKLINNHVQ

SEQ ID NO: 2282 - protein, 23 aa, Artificial
  Peptide with targeting and/or antimicrobial activity
GINTLKKVIQGLHEVIKLVSNHE

SEQ ID NO: 2283 - protein, 23 aa, Artificial
  Peptide with targeting and/or antimicrobial activity
GINTLKKVIQGLHEVIKLVSNHA

SEQ ID NO: 2284 - protein, 15 aa, Artificial
  Peptide with targeting and/or antimicrobial activity
SKGKKANKDVELARG

SEQ ID NO: 2285 - protein, 14 aa, Artificial
  Peptide with targeting and/or antimicrobial activity
FFPIGVFCKIFKTC

SEQ ID NO: 2286 - protein, 21 aa, Artificial
  Peptide with targeting and/or antimicrobial activity
FGLPMLSILPKALCILLKRKC

SEQ ID NO: 2287 - protein, 45 aa, Artificial
  Peptide with targeting and/or antimicrobial activity
FKLGSFLKKAWKSKLAKKLRAKGKEMLKDYAKGLLEGGSEEVPGQ

SEQ ID NO: 2288 - protein, 44 aa, Artificial
  Peptide with targeting and/or antimicrobial activity
GKVWDWIKSTAKKLWNSEPVKELKNTALNAAKNLVAEKIGATPS

SEQ ID NO: 2289 - protein, 44 aa, Artificial
  Peptide with targeting and/or antimicrobial activity
GKVWDWIKSTAKKLWNSEPVKELKNTALNAAKNFVAEKIGATPS

SEQ ID NO: 2290 - protein, 12 aa, Artificial
  Peptide with targeting and/or antimicrobial activity
AERVGAGAPVYL

SEQ ID NO: 2291 - protein, 13 aa, Artificial
  Peptide with targeting and/or antimicrobial activity
PKRKSATKGDEPA

SEQ ID NO: 2292 - protein, 17 aa, Artificial
  Peptide with targeting and/or antimicrobial activity
KAVAAKKSPKKAKKPAT

SEQ ID NO: 2293 - protein, 9 aa, Artificial
  Peptide with targeting and/or antimicrobial activity
DYHHGVRVL

SEQ ID NO: 2294 - protein, 33 aa, Artificial
  Peptide with targeting and/or antimicrobial activity
SHQDCYEALHKCMASHSKPFSCSMKFHMCLQQQ

SEQ ID NO: 2295 - protein, 22 aa, Artificial
  Peptide with targeting and/or antimicrobial activity
ALPKKLKYLNLFNDGFNYMGVV

SEQ ID NO: 2296 - protein, 39 aa, Artificial
  Peptide with targeting and/or antimicrobial activity
GWLKKIGKKIERVGQNTRDATVKGLEVAQQAANVAATVR

SEQ ID NO: 2297 - protein, 35 aa, Artificial
  Peptide with targeting and/or antimicrobial activity
RWKVFKKIEKVGRNIRDGVIKAAPAIEVLGQAKAL

SEQ ID NO: 2298 - protein, 41 aa, Artificial
  Peptide with targeting and/or antimicrobial activity
GKIPIGAIKKAGKAIGKGLRAVNIASTAHDVYTFFKPKKRH

SEQ ID NO: 2299 - protein, 22 aa, Artificial
  Peptide with targeting and/or antimicrobial activity
QRFIHPTYRPPPQPRRPVIMRA

SEQ ID NO: 2300 - protein, 55 aa, Artificial
  Peptide with targeting and/or antimicrobial activity
ATTGCSCPQCIIFDPICASSYKNGRRGFSSGCHMRCYNRCHGTDYFQISKGSKCI

SEQ ID NO: 2301 - protein, 25 aa, Artificial
  Peptide with targeting and/or antimicrobial activity
FFGWLIKGAIHAGKAIHGLIHRRRH

SEQ ID NO: 2302 - protein, 25 aa, Artificial
  Peptide with targeting and/or antimicrobial activity
FFGWLIRGAIHAGKAIHGLIHRRRH

SEQ ID NO: 2303 - protein, 20 aa, Artificial
  Peptide with targeting and/or antimicrobial activity
FIGLLISAGKAIHDLIRRRH

SEQ ID NO: 2304 - protein, 18 aa, Artificial
  Peptide with targeting and/or antimicrobial activity
DWTAWSALVAAACSVELL

SEQ ID NO: 2305 - protein, 10 aa, Artificial
  Peptide with targeting and/or antimicrobial activity
KTCENLADTY

SEQ ID NO: 2306 - protein, 39 aa, Artificial
  Peptide with targeting and/or antimicrobial activity
GWLKKIGKKIERVGQHTRDATIQTIAVAQQAANVAATAR

SEQ ID NO: 2307 - protein, 39 aa, Artificial
  Peptide with targeting and/or antimicrobial activity
GWLKKIGKKIERVGQHTRDATIQTIGVAQQAANVAATLK

SEQ ID NO: 2308 - protein, 32 aa, Artificial
  Peptide with targeting and/or antimicrobial activity
SLGGVISGAKKVAKVAIPIGKAVLPVVAKLVG

SEQ ID NO: 2309 - protein, 26 aa, Artificial
  Peptide with targeting and/or antimicrobial activity
HRHQGPIFDTRPSPFNPNQPRPGPIY

SEQ ID NO: 2310 - protein, 43 aa, Artificial
  Peptide with targeting and/or antimicrobial activity
VTCDILSVEAKGVKLNDAACAAHCLFRGRSGGYCNGKRVCVCR

SEQ ID NO: 2311 - protein, 45 aa, Artificial
  Peptide with targeting and/or antimicrobial activity
GFTQGVRNSQSCRRNKGICVPIRCPGSMRQIGTCLGAQVKCCRRK

SEQ ID NO: 2312 - protein, 29 aa, Artificial
  Peptide with targeting and/or antimicrobial activity
CSCRTSSCRFGERLSGACRLNGRIYRLCC

SEQ ID NO: 2313 - protein, 31 aa, Artificial
  Peptide with targeting and/or antimicrobial activity
ACYCRIGACVSGERLTGACGLNGRIYRLCCR

SEQ ID NO: 2314 - protein, 32 aa, Artificial
  Peptide with targeting and/or antimicrobial activity
VTCYCRSTRCGFRERLSGACGYRGRIYRLCCR

SEQ ID NO: 2315 - protein, 32 aa, Artificial
  Peptide with targeting and/or antimicrobial activity
VTCYCRRTRCGFRERLSGACGYRGRIYRLCCR

SEQ ID NO: 2316 - protein, 31 aa, Artificial
  Peptide with targeting and/or antimicrobial activity
RRCICTTRTCRFPYRRLGTCIFQNRVYTFCC

SEQ ID NO: 2317 - protein, 23 aa, Artificial
  Peptide with targeting and/or antimicrobial activity
CYSAAKYPGFQEFINRKYKSSRF

SEQ ID NO: 2318 - protein, 47 aa, Artificial
  Peptide with targeting and/or antimicrobial activity
HSSGYTRPLPKPSRPIFIRPIGCDVCYGIPSSTARLCCFRYGDCCHR

SEQ ID NO: 2319 - protein, 55 aa, Artificial
  Peptide with targeting and/or antimicrobial activity
QGYKGPYTRPILRPYVRPVVSYNACTLSCRGITTTQARSCSTRLGRCCHVAKGYS

SEQ ID NO: 2320 - protein, 55 aa, Artificial
  Peptide with targeting and/or antimicrobial activity
QGCKGPYTRPILRPYVRPVVSYNACTLSCRGITTTQARSCCTRLGRCCHVAKGYS

SEQ ID NO: 2321 - protein, 47 aa, Artificial
  Peptide with targeting and/or antimicrobial activity
YSSGYTRPLPKPSRPIFIRPIGCDVCYGIPSSTARLCCFRYGDCCHR

SEQ ID NO: 2322 - protein, 21 aa, Artificial
  Peptide with targeting and/or antimicrobial activity
GMASKAGAIAGKIAKVALKAL

SEQ ID NO: 2323 - protein, 27 aa, Artificial
  Peptide with targeting and/or antimicrobial activity
GIGGALLSAGKSALKGLAKGLAEHFAN

SEQ ID NO: 2324 - protein, 32 aa, Artificial
  Peptide with targeting and/or antimicrobial activity
SLGSFLKGVGTTLASVGKVVSDQFGKLLQAGQ

SEQ ID NO: 2325 - protein, 35 aa, Artificial
  Peptide with targeting and/or antimicrobial activity
GGLKKLGKKLEGVGKRVFKASEKALPVLTGYKAIG

SEQ ID NO: 2326 - protein, 49 aa, Artificial
  Peptide with targeting and/or antimicrobial activity
NLCERASLTWTGNCGNTGHCDTQCRNWESAKHGACHKRGNWKCFCYFDC

SEQ ID NO: 2327 - protein, 6 aa, Artificial
  Peptide with targeting and/or antimicrobial activity
RRWQWR

SEQ ID NO: 2328 - protein, 32 aa, Artificial
  Peptide with targeting and/or antimicrobial activity
WKSESVCTPGCVTGVLQTCFLQTITCNCHISK

SEQ ID NO: 2329 - protein, 11 aa, Artificial
  Peptide with targeting and/or antimicrobial activity
RVCYAIPLPIC

SEQ ID NO: 2330 - protein, 27 aa, Artificial
  Peptide with targeting and/or antimicrobial activity
KSKEKIGKEFKRIVQRIKDFLRNLVPR

SEQ ID NO: 2331 - protein, 18 aa, Artificial
  Peptide with targeting and/or antimicrobial activity
GNNRPIYIPQPRPPHPRL

SEQ ID NO: 2332 - protein, 27 aa, Artificial
  Peptide with targeting and/or antimicrobial activity
GFLGPLLKLAAKGVAKVIPHLIPSRQQ

SEQ ID NO: 2333 - protein, 25 aa, Artificial
  Peptide with targeting and/or antimicrobial activity
GCWSTVLGGLKKFAKGGLEAIVNPK

SEQ ID NO: 2334 - protein, 22 aa, Artificial
  Peptide with targeting and/or antimicrobial activity
GVFLDALKKFAKGGMNAVLNPK

SEQ ID NO: 2335 - protein, 18 aa, Artificial
  Peptide with targeting and/or antimicrobial activity
GLLGPLLKIAAKVGSNLL

SEQ ID NO: 2336 - protein, 28 aa, Artificial
  Peptide with targeting and/or antimicrobial activity
RVIEVVQGACRAIRHIPRRIRQGLERIL

SEQ ID NO: 2337 - protein, 29 aa, Artificial
  Peptide with targeting and/or antimicrobial activity
RIAGYGLRGLAVIIRICIRGLNLIFEIIR

SEQ ID NO: 2338 - protein, 10 aa, Artificial
  Peptide with targeting and/or antimicrobial activity
GLLKRIKTLL

SEQ ID NO: 2339 - protein, 22 aa, Artificial
  Peptide with targeting and/or antimicrobial activity
FIHHIFRGIVHAGRSIGRFLTG

SEQ ID NO: 2340 - protein, 31 aa, Artificial
  Peptide with targeting and/or antimicrobial activity
FFSASCVPGADKGQFPNLCRLCAGTGENKCA

SEQ ID NO: 2341 - protein, 47 aa, Artificial
  Peptide with targeting and/or antimicrobial activity
KSCCRNTWARNCYNVCRLPGTISREICAKKCRCKIISGTTCPSDYPK

SEQ ID NO: 2342 - protein, 42 aa, Artificial; identical to SEQ ID NO: 1885
  Peptide with targeting and/or antimicrobial activity

SEQ ID NO: 2343 - protein, 35 aa, Artificial
  Peptide with targeting and/or antimicrobial activity
GFGSLFKFLAKKVAKTVAKQAAKQGAKYIANKQME

SEQ ID NO: 2344 - protein, 35 aa, Artificial
  Peptide with targeting and/or antimicrobial activity
GFGSLFKFLAKKVAKTVAKQAAKQGAKYIANKQTE

SEQ ID NO: 2345 - protein, 35 aa, Artificial
  Peptide with targeting and/or antimicrobial activity
GFGSLFKFLAKKVAKTVAKQAAKQGAKYVANKHME

SEQ ID NO: 2346 - protein, 51 aa, Artificial
  Peptide with targeting and/or antimicrobial activity
SGRGKTGGKARAKAKTRSSRAGLQFPVGRVHRLLRKGNYAHRVGAGAPVYL

SEQ ID NO: 2347 - protein, 43 aa, Artificial; identical to SEQ ID NO: 2012
  Peptide with targeting and/or antimicrobial activity

SEQ ID NO: 2348 - protein, 19 aa, Artificial
  Peptide with targeting and/or antimicrobial activity
AKKVFKRLEKLFSKIQNDK

SEQ ID NO: 2349 - protein, 20 aa, Artificial
  Peptide with targeting and/or antimicrobial activity
ILGPVLGLVSDTLDDVLGIL

SEQ ID NO: 2350 - protein, 34 aa, Artificial
  Peptide with targeting and/or antimicrobial activity
GLVRKGGEKFGEKLRKIGQKIKEFFQKLALEIEQ

SEQ ID NO: 2351 - protein, 18 aa, Artificial
  Peptide with targeting and/or antimicrobial activity
KWKLFKKISKFLHLAKKF

SEQ ID NO: 2352 - protein, 18 aa, Artificial
  Peptide with targeting and/or antimicrobial activity
KWKLFKKILKFLHLAKKF

SEQ ID NO: 2353 - protein, 23 aa, Artificial
  Peptide with targeting and/or antimicrobial activity
FLRFIGSVIHGIGHLVHHIGVAL

SEQ ID NO: 2354 - protein, 12 aa, Artificial
  Peptide with targeting and/or antimicrobial activity
AKRHHGYKRKFH

SEQ ID NO: 2355 - protein, 20 aa, Artificial
  Peptide with targeting and/or antimicrobial activity
LAHQKPFIRKSYKCLHKRCR

SEQ ID NO: 2356 - protein, 21 aa, Artificial
  Peptide with targeting and/or antimicrobial activity
GLLSKVLGVGKKVLCGVSGLC

SEQ ID NO: 2357 - protein, 33 aa, Artificial
  Peptide with targeting and/or antimicrobial activity
GLLDSIKGMAISAGKGALQNLLKVASCKLDKTC

SEQ ID NO: 2358 - protein, 15 aa, Artificial
  Peptide with targeting and/or antimicrobial activity
VAIALKAAHYHTHKE

SEQ ID NO: 2359 - protein, 30 aa, Artificial
  Peptide with targeting and/or antimicrobial activity
ILQKAVLDCLKAAGSSLSKAAITAIYNKIT

SEQ ID NO: 2360 - protein, 18 aa, Artificial
  Peptide with targeting and/or antimicrobial activity
KIGAKIKIGAKIKIGAKI

SEQ ID NO: 2361 - protein, 25 aa, Artificial
  Peptide with targeting and/or antimicrobial activity
IWLTALKFLGKHAAKHLAKQQLSKL

SEQ ID NO: 2362 - protein, 27 aa, Artificial
  Peptide with targeting and/or antimicrobial activity
KIKWFKTMKSIAKFIAKEQMKKHLGGE

SEQ ID NO: 2363 - protein, 20 aa, Artificial
  Peptide with targeting and/or antimicrobial activity
QYRHRCCAWGPGRKYCKRWC

SEQ ID NO: 2364 - protein, 20 aa, Artificial
  Peptide with targeting and/or antimicrobial activity
EWGRRCCGWGPGRRYCRRWC

SEQ ID NO: 2365 - protein, 14 aa, Artificial
  Peptide with targeting and/or antimicrobial activity
KRLFKKLLFSLRKY

SEQ ID NO: 2366 - protein, 14 aa, Artificial
  Peptide with targeting and/or antimicrobial activity
LLLFLLKKRKKRKY

SEQ ID NO: 2367 - protein, 20 aa, Artificial
  Peptide with targeting and/or antimicrobial activity
ILGPVLSMVGSALGGLIKKI

SEQ ID NO: 2368 - protein, 20 aa, Artificial
  Peptide with targeting and/or antimicrobial activity
ILGPVLGLVGNALGGLIKKI

SEQ ID NO: 2369 - protein, 20 aa, Artificial
  Peptide with targeting and/or antimicrobial activity
ILGPVISKIGGVLGGLLKNL

SEQ ID NO: 2370 - protein, 6 aa, Artificial
  Peptide with targeting and/or antimicrobial activity
DDDDDD

SEQ ID NO: 2371 - protein, 29 aa, Artificial
  Peptide with targeting and/or antimicrobial activity
VLSKSLCTPGCITGPLQTCYLCFPTFAKC

SEQ ID NO: 2372 - protein, 28 aa, Artificial
  Peptide with targeting and/or antimicrobial activity
GKQYFPKVGGRLSGKAPLAAKTHRRLKP

SEQ ID NO: 2373 - protein, 20 aa, Artificial
  Peptide with targeting and/or antimicrobial activity
KTCENLADTFRGPCFATSNC

SEQ ID NO: 2374 - protein, 25 aa, Artificial
  Peptide with targeting and/or antimicrobial activity
GVVDILKGAAKDIAGHLASKVMNKL

SEQ ID NO: 2375 - protein, 20 aa, Artificial
  Peptide with targeting and/or antimicrobial activity
KSCCRNTTARNCYNVCRIPG

SEQ ID NO: 2376 - protein, 56 aa, Artificial
  Peptide with targeting and/or antimicrobial activity
GLGSVFGRLARILGRVIPKVAKKLGPKVAKVLPKVMKEAIPMAVEMAKSQEEQQPQ

SEQ ID NO: 2377 - protein, 88 aa, Artificial
  Peptide with targeting and/or antimicrobial activity
SVRTQDNAVNRQIFGSNGPYRDFQLSDCYLPLETNPYCNEWQFAYHWNNALMDCERAIYHGCNRTRNNFITLTACKNQAGPICNRRRH

SEQ ID NO: 2378 - protein, 30 aa, Artificial
  Peptide with targeting and/or antimicrobial activity
AEVAPAPAAAAPAKAPKKKAAAKPKKAGPS

SEQ ID NO: 2379 - protein, 18 aa, Artificial
  Peptide with targeting and/or antimicrobial activity
WLNALLHHGLNCAKGVLA

SEQ ID NO: 2380 - protein, 38 aa, Artificial
  Peptide with targeting and/or antimicrobial activity
GFGCPWNRYQCHSHCRSIGRLGGYCAGSLRLTCTCYRS

SEQ ID NO: 2381 - protein, 25 aa, Artificial
  Peptide with targeting and/or antimicrobial activity
GLLDTLKGAAKNVVGSLASKVMEKL

SEQ ID NO: 2382 - protein, 14 aa, Artificial
  Peptide with targeting and/or antimicrobial activity
IDWKKLLDAAKQIL

SEQ ID NO: 2383 - protein, 12 aa, Artificial
  Peptide with targeting and/or antimicrobial activity
ILGTILGLLKSL

SEQ ID NO: 2384 - protein, 25 aa, Artificial
  Peptide with targeting and/or antimicrobial activity
GVVDILKGAGKDLLAHLVGKISEKV

SEQ ID NO: 2385 - protein, 22 aa, Artificial
  Peptide with targeting and/or antimicrobial activity
GVLDIFKDAAKQILAHAAEKQI

SEQ ID NO: 2386 - protein, 21 aa, Artificial
  Peptide with targeting and/or antimicrobial activity
GVLDILKNAAKNILAHAAEQI

SEQ ID NO: 2387 - protein, 27 aa, Artificial
  Peptide with targeting and/or antimicrobial activity
RFGRFLRKIRRFRPKVTITIQGSARFG

SEQ ID NO: 2388 - protein, 46 aa, Artificial
  Peptide with targeting and/or antimicrobial activity
KSCCRNTVARNCYNVCRIPGTPRPVCAATCDCKLITGTKCPPGYEK

SEQ ID NO: 2389 - protein, 6 aa, Artificial
  Peptide with targeting and/or antimicrobial activity
FRWWHR

SEQ ID NO: 2390 - protein, 27 aa, Artificial
  Peptide with targeting and/or antimicrobial activity
GIGRKFLGGVKTTFRCGVKDFASKHLY

SEQ ID NO: 2391 - protein, 42 aa, Artificial
  Peptide with targeting and/or antimicrobial activity
GKIPVKAIKKAGAAIGKGLRAINIASTAHDVYSFFKPKHKKK

SEQ ID NO: 2392 - protein, 19 aa, Artificial
  Peptide with targeting and/or antimicrobial activity
KGRGKQGGKVRAKAKTRSS

SEQ ID NO: 2393 - protein, 21 aa, Artificial
  Peptide with targeting and/or antimicrobial activity
GFMKYIGPLIPHAVKAISDLI

SEQ ID NO: 2394 - protein, 26 aa, Artificial
  Peptide with targeting and/or antimicrobial activity
RVKRVWPLVIRTVIAGYNLYRAIKKK

SEQ ID NO: 2395 - protein, 25 aa, Artificial
  Peptide with targeting and/or antimicrobial activity
ATRVVYCNRRSGSVVGGDDTVYYEG

SEQ ID NO: 2396 - protein, 35 aa, Artificial
  Peptide with targeting and/or antimicrobial activity
TTLTLHNLCPYPVWWLVTPNNGGFPIIDNTPVVLG

SEQ ID NO: 2397 - protein, 10 aa, Artificial
  Peptide with targeting and/or antimicrobial activity
EQCREEEDDR

SEQ ID NO: 2398 - protein, 44 aa, Artificial
  Peptide with targeting and/or antimicrobial activity
GKVWDWIKSAAKKIWSSEPVSQLKGQVLNAAKNYVAEKIGATPT

SEQ ID NO: 2399 - protein, 47 aa, Artificial
  Peptide with targeting and/or antimicrobial activity
KTCENLADTFRGPCFATSNCDDHCKNKEHLLSGRCRDDFRCWCTRNC

SEQ ID NO: 2400 - protein, 17 aa, Artificial
  Peptide with targeting and/or antimicrobial activity
FLIGMTHGLICLISRKC

SEQ ID NO: 2401 - protein, 17 aa, Artificial
  Peptide with targeting and/or antimicrobial activity
FLIGMTQGLICLITRKC

SEQ ID NO: 2402 - protein, 33 aa, Artificial
  Peptide with targeting and/or antimicrobial activity
GLFDVVKGVLKGVGKNVAGSLLEQLKCKLSGGC

SEQ ID NO: 2403 - protein, 15 aa, Artificial
  Peptide with targeting and/or antimicrobial activity
VWPLGLVICKALKIC

SEQ ID NO: 2404 - protein, 38 aa, Artificial
  Peptide with targeting and/or antimicrobial activity
GLFSVVTGVLKAVGKNVAKNVGGSLLEQLKCKKISGGC

SEQ ID NO: 2405 - protein, 20 aa, Artificial
  Peptide with targeting and/or antimicrobial activity
FLPLLLAGLPLKLCFLFKKC

SEQ ID NO: 2406 - protein, 26 aa, Artificial
  Peptide with targeting and/or antimicrobial activity
SIITMTKEAKLPQLWKQIACRLYNTC

SEQ ID NO: 2407 - protein, 26 aa, Artificial
  Peptide with targeting and/or antimicrobial activity
SIITMTKEAKLPQSWKQIACRLYNTC

SEQ ID NO: 2408 - protein, 46 aa, Artificial
  Peptide with targeting and/or antimicrobial activity
GLFSKFAGKGIKNLIFKGVKHIGKEVGMDVIRTGIDVAGCKIKGEC

SEQ ID NO: 2409 - protein, 33 aa, Artificial
  Peptide with targeting and/or antimicrobial activity
GLLDTFKNLALNAAKSAGVSVLNSLSCKLSKTC

SEQ ID NO: 2410 - protein, 33 aa, Artificial
  Peptide with targeting and/or antimicrobial activity
GVLGTVKNLLIGAGKSAAQSVLKTLSCKLSNDC

SEQ ID NO: 2411 - protein, 37 aa, Artificial
  Peptide with targeting and/or antimicrobial activity
GLFTLIKGAAKLIGKTVAKEAGKTGLELMACKITNQC

SEQ ID NO: 2412 - protein, 24 aa, Artificial
  Peptide with targeting and/or antimicrobial activity
FLPLLAGLAANFLPKIFCKITKKC

SEQ ID NO: 2413 - protein, 21 aa, Artificial
  Peptide with targeting and/or antimicrobial activity
GLLSGILGAGKHIVCGLSGLC

SEQ ID NO: 2414 - protein, 21 aa, Artificial
  Peptide with targeting and/or antimicrobial activity
GLFGKILGVGKKVLCGLSGMC

SEQ ID NO: 2415 - protein, 21 aa, Artificial
  Peptide with targeting and/or antimicrobial activity
GLLSGILGAGKNIVCGLSGLC

SEQ ID NO: 2416 - protein, 34 aa, Artificial
  Peptide with targeting and/or antimicrobial activity
GFSSLFKAGAKYLLKSVGKAGAQQLACKAANNCA

SEQ ID NO: 2417 - protein, 30 aa, Artificial
  Peptide with targeting and/or antimicrobial activity
GVITDALKGAAKTVAAELLRKAHCKLTNSC

SEQ ID NO: 2418 - protein, 26 aa, Artificial
  Peptide with targeting and/or antimicrobial activity
VIDDLKKVAKKVRRELLCKKHHKKLN

SEQ ID NO: 2419 - protein, 31 aa, Artificial
  Peptide with targeting and/or antimicrobial activity
SIWEGIKNAGKGFLVSILDKVRCKVAGGCNP

SEQ ID NO: 2420 - protein, 13 aa, Artificial
  Peptide with targeting and/or antimicrobial activity
FLPLLFGAISHLL

SEQ ID NO: 2421 - protein, 33 aa, Artificial
  Peptide with targeting and/or antimicrobial activity
GIMSLFKGVLKTAGKHVAGSLVDQLKCKITGGC

SEQ ID NO: 2422 - protein, 22 aa, Artificial
  Peptide with targeting and/or antimicrobial activity
FLGSIVGALASALPSLISKIRN

SEQ ID NO: 2423 - protein, 13 aa, Artificial
  Peptide with targeting and/or antimicrobial activity
FLGALAKIISGIF

SEQ ID NO: 2424 - protein, 24 aa, Artificial
  Peptide with targeting and/or antimicrobial activity
FLPILAGLAAKIVPKLFCLATKKC

SEQ ID NO: 2425 - protein, 13 aa, Artificial
  Peptide with targeting and/or antimicrobial activity
FLPIVGKLLSGLL

SEQ ID NO: 2426 - protein, 13 aa, Artificial
  Peptide with targeting and/or antimicrobial activity
FLPIIGKLLSGLL

SEQ ID NO: 2427 - protein, 13 aa, Artificial
  Peptide with targeting and/or antimicrobial activity
FLPLVTGLLSGLL

SEQ ID NO: 2428 - protein, 14 aa, Artificial
  Peptide with targeting and/or antimicrobial activity
NFLGTLVNLAKKIL

SEQ ID NO: 2429 - protein, 13 aa, Artificial
  Peptide with targeting and/or antimicrobial activity
FLSAITSLLGKLL

SEQ ID NO: 2430 - protein, 21 aa, Artificial
  Peptide with targeting and/or antimicrobial activity
GIWDTIKSMGKVFAGKILQNL

SEQ ID NO: 2431 - protein, 23 aa, Artificial
  Peptide with targeting and/or antimicrobial activity
GLLRASSVWGRKYYVDLAGCAKA

SEQ ID NO: 2432 - protein, 20 aa, Artificial
  Peptide with targeting and/or antimicrobial activity
FLSLALAALPKFLCLVFKKC

SEQ ID NO: 2433 - protein, 20 aa, Artificial
  Peptide with targeting and/or antimicrobial activity
FLSLALAALPKLFCLIFKKC

SEQ ID NO: 2434 - protein, 20 aa, Artificial
  Peptide with targeting and/or antimicrobial activity
FLPLLLAGLPKLLCLFFKKC

SEQ ID NO: 2435 - protein, 33 aa, Artificial
  Peptide with targeting and/or antimicrobial activity
GLFDVVKGVLKGAGKNVAGSLLEQLKCKLSGGC

SEQ ID NO: 2436 - protein, 33 aa, Artificial; identical to SEQ ID NO: 2402
  Peptide with targeting and/or antimicrobial activity

SEQ ID NO: 2437 - protein, 33 aa, Artificial
  Peptide with targeting and/or antimicrobial activity
GIFDVVKGVLKGVGKNVAGSLLEQLKCKLSGGC

SEQ ID NO: 2438 - protein, 37 aa, Artificial
  Peptide with targeting and/or antimicrobial activity
GLFSVVTGVLKAVGKNVAKNVGGSLLEQLKCKISGGC

SEQ ID NO: 2439 - protein, 14 aa, Artificial
  Peptide with targeting and/or antimicrobial activity
FIGPIISALASLFG

SEQ ID NO: 2440 - protein, 28 aa, Artificial
  Peptide with targeting and/or antimicrobial activity
ALFSILRGLKKLGNMGQAFVNCKIYKKC

SEQ ID NO: 2441 - protein, 27 aa, Artificial
  Peptide with targeting and/or antimicrobial activity
ALSILRGLEKLAKMGIALTNCKATKKC

SEQ ID NO: 2442 - protein, 27 aa, Artificial
  Peptide with targeting and/or antimicrobial activity
ALSILKGLEKLAKMGIALTNCKATKKC

SEQ ID NO: 2443 - protein, 31 aa, Artificial
  Peptide with targeting and/or antimicrobial activity
GFFSTVKNLATNVAGTVIDTLKCKVTGGCRS

SEQ ID NO: 2444 - protein, 31 aa, Artificial
  Peptide with targeting and/or antimicrobial activity
GFLSTVKNLATNVAGTVIDTLKCKVTGGCRS

SEQ ID NO: 2445 - protein, 48 aa, Artificial
  Peptide with targeting and/or antimicrobial activity
GIFPKIIGKGIKTGIVNGIKSLVKGVGMKVFKAGLNNIGNTGCNEDEC

SEQ ID NO: 2446 - protein, 48 aa, Artificial
  Peptide with targeting and/or antimicrobial activity
GIFPKIIGKGIKTGIVNGIKSLVKGVGMKVFKAGLSNIGNTGCNEDEC

SEQ ID NO: 2447 - protein, 38 aa, Artificial
  Peptide with targeting and/or antimicrobial activity
ALLGDFFRKSKEKIGKEFKRIVQRIKDFLRNLVPRTES

SEQ ID NO: 2448 - protein, 20 aa, Artificial
  Peptide with targeting and/or antimicrobial activity
KRIVQRIKDFLRNLVPRTES

SEQ ID NO: 2449 - protein, 30 aa, Artificial
  Peptide with targeting and/or antimicrobial activity
KSKEKIGKEFKRIVQRIKDFLRNLVPRTES

SEQ ID NO: 2450 - protein, 31 aa, Artificial
  Peptide with targeting and/or antimicrobial activity
RKSKEKIGKEFKRIVQRIKDFLRNLVPRTES

SEQ ID NO: 2451 - protein, 23 aa, Artificial
  Peptide with targeting and/or antimicrobial activity
LLGDFFRKSKEKIGKEFKRIVQR

SEQ ID NO: 2452 - protein, 29 aa, Artificial
  Peptide with targeting and/or antimicrobial activity
LLGDFFRKSKEKIGKEFKRIVQRIKDFLR

SEQ ID NO: 2453 - protein, 25 aa, Artificial
  Peptide with targeting and/or antimicrobial activity
GEILCNLCTGLINTLENLLTTKGAD

SEQ ID NO: 2454 - protein, 43 aa, Artificial
  Peptide with targeting and/or antimicrobial activity
KYYGNGVSCNKKGCSVDWGKAIGIIGNNSAANLATGGAAGWSK

SEQ ID NO: 2455 - protein, 22 aa, Artificial
  Peptide with targeting and/or antimicrobial activity
GLIGSIGKALGGLLVDVLKPKL

SEQ ID NO: 2456 - protein, 26 aa, Artificial
  Peptide with targeting and/or antimicrobial activity
GLIGSIGKALGGLLVDVLKPKLQAAS

SEQ ID NO: 2457 - protein, 21 aa, Artificial
  Peptide with targeting and/or antimicrobial activity
GLLGLLGSVVSHVVPAIVGHF

SEQ ID NO: 2458 - protein, 33 aa, Artificial
  Peptide with targeting and/or antimicrobial activity
GFFALIPKIISSPLFKTLLSAVGSALSSSGEQE

SEQ ID NO: 2459 - protein, 33 aa, Artificial
  Peptide with targeting and/or antimicrobial activity
GFFALIPKIISSPIFKTLLSAVGSALSSSGGQE

SEQ ID NO: 2460 - protein, 33 aa, Artificial
  Peptide with targeting and/or antimicrobial activity
GFFAFIPKIISSPLFKTLLSAVGSALSSSGEQE

SEQ ID NO: 2461 - protein, 33 aa, Artificial
  Peptide with targeting and/or antimicrobial activity
GFFAFIPKIISSPLFKTLLSAVGSALSSSGDQE

SEQ ID NO: 2462 - protein, 24 aa, Artificial
  Peptide with targeting and/or antimicrobial activity
FLPLIAGLAANFLPKIFCAITKKC

SEQ ID NO: 2463 - protein, 24 aa, Artificial
  Peptide with targeting and/or antimicrobial activity
FLPVIAGVAAKFLPKIFCAITKKC

SEQ ID NO: 2464 - protein, 46 aa, Artificial
  Peptide with targeting and/or antimicrobial activity
GLFPKINKKKAKTGVFNIIKTVGKEAGMDLIRTGIDTIGCKIKGEC

SEQ ID NO: 2465 - protein, 46 aa, Artificial
  Peptide with targeting and/or antimicrobial activity
GIFTKINKKKAKTGVFNIIKTIGKEAGMDVIRAGIDTISCKIKGEC

SEQ ID NO: 2466 - protein, 37 aa, Artificial
  Peptide with targeting and/or antimicrobial activity
GLFSILKGVGKIALKGLAKNMGKMGLDLVSCKISKEC

SEQ ID NO: 2467 - protein, 28 aa, Artificial
  Peptide with targeting and/or antimicrobial activity
GIMDTVKNVAKNLAGQLLDKLKCKITAC

SEQ ID NO: 2468 - protein, 28 aa, Artificial
  Peptide with targeting and/or antimicrobial activity
GIMDTVKNAAKDLAGQLLDKLKCRITGC

SEQ ID NO: 2469 - protein, 28 aa, Artificial
  Peptide with targeting and/or antimicrobial activity
GLLDTIKNTAKNLAVGLLDKIKCKMTGC

SEQ ID NO: 2470 - protein, 28 aa, Artificial
  Peptide with targeting and/or antimicrobial activity
GIMDSVKNVAKNIAGQLLDKLKCKITGC

SEQ ID NO: 2471 - protein, 28 aa, Artificial
  Peptide with targeting and/or antimicrobial activity
GIMDSVKNAAKNLAGQLLDTIKCKITAC

SEQ ID NO: 2472 - protein, 27 aa, Artificial
  Peptide with targeting and/or antimicrobial activity
GIMDTVKNAAKDLAGQLDKLKCRITGC

SEQ ID NO: 2473 - protein, 13 aa, Artificial
  Peptide with targeting and/or antimicrobial activity
FLPLVGKILSGLI

SEQ ID NO: 2474 - protein, 12 aa, Artificial
  Peptide with targeting and/or antimicrobial activity
FLPIASLLGKYL

SEQ ID NO: 2475 - protein, 37 aa, Artificial
  Peptide with targeting and/or antimicrobial activity
GILSLFTGGIKALGKTLFKMAGKAGAEHLACKATNQC

SEQ ID NO: 2476 - protein, 37 aa, Artificial
  Peptide with targeting and/or antimicrobial activity
GLFSILRGAAKFASKGLGKDLTKLGVDLVACKISKQC

SEQ ID NO: 2477 - protein, 37 aa, Artificial
  Peptide with targeting and/or antimicrobial activity
GFSSIFRGVAKFASKGLGKDLARLGVNLVACKISKQC

SEQ ID NO: 2478 - protein, 13 aa, Artificial
  Peptide with targeting and/or antimicrobial activity
FLPAIAGILSQLF

SEQ ID NO: 2479 - protein, 13 aa, Artificial
  Peptide with targeting and/or antimicrobial activity
FLPLIAGLIGKLF

SEQ ID NO: 2480 - protein, 13 aa, Artificial
  Peptide with targeting and/or antimicrobial activity
EGGGPQWAVGHFM

SEQ ID NO: 2481 - protein, 11 aa, Artificial
  Peptide with targeting and/or antimicrobial activity
EPHPDEFVGLM

SEQ ID NO: 2482 - protein, 11 aa, Artificial
  Peptide with targeting and/or antimicrobial activity
EPNPDEFVGLM

SEQ ID NO: 2483 - protein, 11 aa, Artificial
  Peptide with targeting and/or antimicrobial activity
EPHPNEFVGLM

SEQ ID NO: 2484 - protein, 11 aa, Artificial
  Peptide with targeting and/or antimicrobial activity
EPNPDEFFGLM

SEQ ID NO: 2485 - protein, 24 aa, Artificial
  Peptide with targeting and/or antimicrobial activity
FWGALAKGALKLIPSLFSSFSKKD

SEQ ID NO: 2486 - protein, 11 aa, Artificial
  Peptide with targeting and/or antimicrobial activity
EPNPNEFFGLM

SEQ ID NO: 2487 - protein, 32 aa, Artificial; identical to SEQ ID NO: 2328
  Peptide with targeting and/or antimicrobial activity

SEQ ID NO: 2488 - protein, 29 aa, Artificial
  Peptide with targeting and/or antimicrobial activity
VLSKSLCTPGCITGPLQTCYLCFPTFAKC

SEQ ID NO: 2489 - protein, 49 aa, Artificial
  Peptide with targeting and/or antimicrobial activity
FELDRICGYGTARCRKKCRSQEYRIGRCPNTYACCLRKWDESLLNRTKP

SEQ ID NO: 2490 - protein, 37 aa, Artificial
  Peptide with targeting and/or antimicrobial activity
RLGNFFRKVKEKIGGGLKKVGQKIKDFLGNLVPRTAS

SEQ ID NO: 2491 - protein, 43 aa, Artificial
  Peptide with targeting and/or antimicrobial activity
GLRKKFRKTRKRIQKLGRKIGKTGRKVWKAWREYGQIPYPCRI

SEQ ID NO: 2492 - protein, 38 aa, Artificial
  Peptide with targeting and/or antimicrobial activity
RLKELITTGGQKIGEKIRRIGQRIKDFFKNLQPREEKS

SEQ ID NO: 2493 - protein, 37 aa, Artificial
  Peptide with targeting and/or antimicrobial activity
GLFSILKGVGKIAIKGLGKNLGKMGLDLVSCKISKEC

SEQ ID NO: 2494 - protein, 33 aa, Artificial
  Peptide with targeting and/or antimicrobial activity
GLFGRLRDSLQRGGQKILEKAERIWCKIKDIFR

SEQ ID NO: 2495 - protein, 43 aa, Artificial
  Peptide with targeting and/or antimicrobial activity
RFRPPIRRPPIRPPFRPPFRPPVRPPIRPPFRPPFRPPIGPFP

SEQ ID NO: 2496 - protein, 52 aa, Artificial
  Peptide with targeting and/or antimicrobial activity
RRLRPRHQHFPSERPWPKPLPLPLPRPGPRPWPKPLPLPLPRPGLRPWPKPL

SEQ ID NO: 2497 - protein, 60 aa, Artificial
  Peptide with targeting and/or antimicrobial activity
RRLRPRRPRLPRPRPRPRPRPRSLPLPRPQPRRIPRPILLPWRPPRPIPRPQIQPIPRWL

SEQ ID NO: 2498 - protein, 94 aa, Artificial
  Peptide with targeting and/or antimicrobial activity
RRLRPRRPRLPRPRPRPRPRPRSLPLPRPKPRPIPRPLPLPRPRPKPIPRPLPLPRPRPRRIPRPLPLPRPRPRPIPRPLPLPQPQPSPIPRPL

SEQ ID NO: 2499 - protein, 28 aa, Artificial
  Peptide with targeting and/or antimicrobial activity
GIMDTVKGVAKTVAASLLDKLKCKITGC

SEQ ID NO: 2500 - protein, 26 aa, Artificial
  Peptide with targeting and/or antimicrobial activity
KRFGRLAKSFLRMRILLPRRKILLAS

SEQ ID NO: 2501 - protein, 27 aa, Artificial
  Peptide with targeting and/or antimicrobial activity
KRRHWFPLSFQEFLEQLRRFRDQLPFP

SEQ ID NO: 2502 - protein, 40 aa, Artificial
  Peptide with targeting and/or antimicrobial activity
KRFHSVGSLIQRHQQMIRDKSEATRHGIRIITRPKLLLAS

SEQ ID NO: 2503 - protein, 79 aa, Artificial
  Peptide with targeting and/or antimicrobial activity
AFPPPNVPGPRFPPPNFPGPRFPPPNFPGPRFPPPNFPGPRFPPPNFPGPPFPPPIFPGPWFPPPPPFRPPPFGPPRFP

SEQ ID NO: 2504 - protein, 79 aa, Artificial
  Peptide with targeting and/or antimicrobial activity
AFPPPNVPGPRFPPPNVPGPRFPPPNFPGPRFPPPNFPGPRFPPPNFPGPPFPPPIFPGPWFPPPPPFRPPPFGPPRFP

SEQ ID NO: 2505 - protein, 37 aa, Artificial
  Peptide with targeting and/or antimicrobial activity
GFFKKAWRKVKHAGRRVLDTAKGVGRHYVNNWLNRYR

SEQ ID NO: 2506 - protein, 30 aa, Artificial
  Peptide with targeting and/or antimicrobial activity
GWFKKAWRKVKNAGRRVLKGVGIHYGVGLI

SEQ ID NO: 2507 - protein, 66 aa, Artificial
  Peptide with targeting and/or antimicrobial activity
RICSRDKNCVSRPGVGSIIGRPGGGSLIGRPGGGSVIGRPGGGSPPGGGSFNDEFIRDHSDGNRFA

SEQ ID NO: 2508 - protein, 23 aa, Artificial
  Peptide with targeting and/or antimicrobial activity
AIGSILGALAKGLPTLISWIKNR

SEQ ID NO: 2509 - protein, 13 aa, Artificial
  Peptide with targeting and/or antimicrobial activity
FLPILGKLLSGIL

SEQ ID NO: 2510 - protein, 13 aa, Artificial
  Peptide with targeting and/or antimicrobial activity
GLFDIIKNIVSTL

SEQ ID NO: 2511 - protein, 13 aa, Artificial
  Peptide with targeting and/or antimicrobial activity
GLFDIIKNIFSGL

SEQ ID NO: 2512 - protein, 23 aa, Artificial
  Peptide with targeting and/or antimicrobial activity
GLWQLIKDKIKDAATGFVTGIQS

SEQ ID NO: 2513 - protein, 23 aa, Artificial
  Peptide with targeting and/or antimicrobial activity
GLWQFIKDKLKDAATGLVTGIQS

SEQ ID NO: 2514 - protein, 23 aa, Artificial
  Peptide with targeting and/or antimicrobial activity
GLWQFIKDKFKDAATGLVTGIQS

SEQ ID NO: 2515 - protein, 20 aa, Artificial
  Peptide with targeting and/or antimicrobial activity
GLLGSIGNAIGAFIANKLKP

SEQ ID NO: 2516 - protein, 21 aa, Artificial
  Peptide with targeting and/or antimicrobial activity
GLLGSIGNAIGAFIANKLKPK

SEQ ID NO: 2517 - protein, 20 aa, Artificial
  Peptide with targeting and/or antimicrobial activity
GLLASLGKVLGGYLAEKLKP

SEQ ID NO: 2518 - protein, 21 aa, Artificial
  Peptide with targeting and/or antimicrobial activity
GLLGSIGKVLGGYLAEKLKPK

SEQ ID NO: 2519 - protein, 21 aa, Artificial
  Peptide with targeting and/or antimicrobial activity
GLLASLGKVLGGYLAEKLKPK

SEQ ID NO: 2520 - protein, 21 aa, Artificial
  Peptide with targeting and/or antimicrobial activity
GLLASLGKVFGGYLAEKLKPK

SEQ ID NO: 2521 - protein, 37 aa, Artificial
  Peptide with targeting and/or antimicrobial activity
GFGCPNDYPCHRHCKSIPGRAGGYCGGAHRLRCTCYR

SEQ ID NO: 2522 - protein, 39 aa, Artificial
  Peptide with targeting and/or antimicrobial activity
GFGCPNNYACHQHCKSIRGYCGGYCAGWFRLRCTCYRCG

SEQ ID NO: 2523 - protein, 37 aa, Artificial
  Peptide with targeting and/or antimicrobial activity
GFGCPLNQGACHRHCRSIRRRGGYCAGFFKQTCCYRN

SEQ ID NO: 2524 - protein, 37 aa, Artificial
  Peptide with targeting and/or antimicrobial activity
GFGCPFNQGACHRHCRSIRRRGGYCAGLFKQTCTCYR

SEQ ID NO: 2525 - protein, 37 aa, Artificial
  Peptide with targeting and/or antimicrobial activity
GYGCPFNQYQCHSHCSGIRGYKGGYCKGTFKQTCKCY

SEQ ID NO: 2526 - protein, 45 aa, Artificial
  Peptide with targeting and/or antimicrobial activity
RTCMKKEGWGKCLIDTTCAHSCKNRGYIGGNCKGMTRTCYCLVNC

SEQ ID NO: 2527 - protein, 24 aa, Artificial
  Peptide with targeting and/or antimicrobial activity
GLLNGLALRLGKRALKKIIKRLCR

SEQ ID NO: 2528 - protein, 11 aa, Artificial
  Peptide with targeting and/or antimicrobial activity
SLLSLLRKLIT

SEQ ID NO: 2529 - protein, 18 aa, Artificial
  Peptide with targeting and/or antimicrobial activity
RCLCRRGVCRCLCRRGVC

SEQ ID NO: 2530 - protein, 18 aa, Artificial
  Peptide with targeting and/or antimicrobial activity
RCICTRGFCRCICTRGFC

SEQ ID NO: 2531 - protein, 6 aa, Artificial
  Peptide with targeting and/or antimicrobial activity
RRWWRF

SEQ ID NO: 2532 - protein, 37 aa, Artificial
  Peptide with targeting and/or antimicrobial activity
DIQIPGIKKPTHRDIIIPNWNPNVRTQPWQRFGGNKS

SEQ ID NO: 2533 - protein, 42 aa, Artificial
  Peptide with targeting and/or antimicrobial activity
EADEPLWLYKGDNIERAPTTADHPILPSIIDDVKLDPNRRYA

SEQ ID NO: 2534 - protein, 42 aa, Artificial
  Peptide with targeting and/or antimicrobial activity
EIRLPEPFRFPSPTVPKPIDIDPILPHPWSPRQTYPIIARRS

SEQ ID NO: 2535 - protein, 44 aa, Artificial
  Peptide with targeting and/or antimicrobial activity
DKLIGSCVWGATNYTSDCNAECKRRGYKGGHCGSFWNVNCWCEE

SEQ ID NO: 2536 - protein, 51 aa, Artificial
  Peptide with targeting and/or antimicrobial activity
VQETQKLAKTVGANLEETNKKLAPQIKSAYDDFVKQAQEVQKKLHEAASKQ

SEQ ID NO: 2537 - protein, 60 aa, Artificial
  Peptide with targeting and/or antimicrobial activity
ETESTPDYLKNIQQQLEEYTKNFNTQVQNAFDSDKIKSEVNNFIESLGKILNTEKKEAPK

SEQ ID NO: 2538 - protein, 39 aa, Artificial
  Peptide with targeting and/or antimicrobial activity
ENFFKEIERAGQRIRDAIISAAPAVETLAQAQKIIKGGD

SEQ ID NO: 2539 - protein, 24 aa, Artificial
  Peptide with targeting and/or antimicrobial activity
ALWKDILKNAGKAALNEINQLVNQ

SEQ ID NO: 2540 - protein, 20 aa, Artificial
  Peptide with targeting and/or antimicrobial activity
FLSLIPHAINAVSTLVHHSG

SEQ ID NO: 2541 - protein, 19 aa, Artificial
  Peptide with targeting and/or antimicrobial activity
FLSLIPHAINAVSAIAKHS

SEQ ID NO: 2542 - protein, 17 aa, Artificial
  Peptide with targeting and/or antimicrobial activity
SLIPHAINAVSAIAKHF

SEQ ID NO: 2543 - protein, 19 aa, Artificial
  Peptide with targeting and/or antimicrobial activity
FLSLIPHAINAVSAIAKHF

SEQ ID NO: 2544 - protein, 25 aa, Artificial
  Peptide with targeting and/or antimicrobial activity
GLWSTIKNVGKEAAIAAGKAALGAL

SEQ ID NO: 2545 - protein, 24 aa, Artificial
  Peptide with targeting and/or antimicrobial activity
GLRSKIWLWVLLMIWQESNKFKKM

SEQ ID NO: 2546 - protein, 46 aa, Artificial [sequence omitted]

SEQ ID NO: 2547 - protein, 58 aa, Artificial
  Peptide with targeting and/or antimicrobial activity
IYWIADQFGIHLATGTARKLLDAMASGASLGTAFAAILGVTLPAWALAAAGALGATAA

SEQ ID NO: 2548 - protein, 69 aa, Artificial
  Peptide with targeting and/or antimicrobial activity
VAGALGVQTAAATTIVNVILNAGTLVTVLGIIASIASGGAGTLMTIGWATFKATVQKLAKQSMARAIAY

SEQ ID NO: 2549 - protein, 82 aa, Artificial
  Peptide with targeting and/or antimicrobial activity
PNWTKIGKCAGSIAWAIGSGLFGGAKLIKIKKYIAELGGLQKAAKLLVGATTWEEKLHAGGYALINLAAELTGVAGIQANCF

SEQ ID NO: 2550 - protein, 25 aa, Artificial
  Peptide with targeting and/or antimicrobial activity
GLLGAMFKVASKVLPHVVPAITEHF

SEQ ID NO: 2551 - protein, 21 aa, Artificial
  Peptide with targeting and/or antimicrobial activity
GLLGLLGSVVSHVLPAITQHL

SEQ ID NO: 2552 - protein, 23 aa, Artificial
  Peptide with targeting and/or antimicrobial activity
GIGKFLHSAGKFGKAFVGEIMKS

SEQ ID NO: 2553 - protein, 48 aa, Artificial
  Peptide with targeting and/or antimicrobial activity
FRGLAKLLKIGLKSFARVLKKVLPKAAKAGKALAKSMADENAIRQQNQ

SEQ ID NO: 2554 - protein, 37 aa, Artificial
  Peptide with targeting and/or antimicrobial activity
GKFSVFGKILRSIAKVFKGVGKVRKQFKTASDLDKNQ

SEQ ID NO: 2555 - protein, 37 aa, Artificial
  Peptide with targeting and/or antimicrobial activity
GKFSGFAKILKSIAKFFKGVGKVRKGFKEASDLDKNQ

SEQ ID NO: 2556 - protein, 37 aa, Artificial
  Peptide with targeting and/or antimicrobial activity
GKLSGISKVLRAIAKFFKGVGKARKQFKEASDLDKNQ

SEQ ID NO: 2557 - protein, 37 aa, Artificial
  Peptide with targeting and/or antimicrobial activity
GKFSVFSKILRSIAKVFKGVGKVRKGFKTASDLDKNQ

SEQ ID NO: 2558 - protein, 24 aa, Artificial
  Peptide with targeting and/or antimicrobial activity
GKGRWLERIGKAGGIIIGGALDHL

SEQ ID NO: 2559 - protein, 20 aa, Artificial
  Peptide with targeting and/or antimicrobial activity
WLRRIGKGVKIIGGAALDHL

SEQ ID NO: 2560 - protein, 26 aa, Artificial
  Peptide with targeting and/or antimicrobial activity
GRRKRKWLRRIGKGVKIIGGAALDHL

SEQ ID NO: 2561 - protein, 24 aa, Artificial
  Peptide with targeting and/or antimicrobial activity
FLGALIKGAIHGGRFIHGMIQNHH

SEQ ID NO: 2562 - protein, 25 aa, Artificial
  Peptide with targeting and/or antimicrobial activity
GWGSIFKHGRHAAKHIGHAAVNHYL

SEQ ID NO: 2563 - protein, 25 aa, Artificial
  Peptide with targeting and/or antimicrobial activity
RWGKWFKKATHVGKHVGKAALTAYL

SEQ ID NO: 2564 - protein, 19 aa, Artificial
  Peptide with targeting and/or antimicrobial activity
FFRLLFHGVHHVGKIKPRA

SEQ ID NO: 2565 - protein, 25 aa, Artificial
  Peptide with targeting and/or antimicrobial activity
GWKSVFRKAKKVGKTVGGLALDHYL

SEQ ID NO: 2566 - protein, 25 aa, Artificial
  Peptide with targeting and/or antimicrobial activity
GWKKWFNRAKKVGKTVGGLAVDHYL

SEQ ID NO: 2567 - protein, 23 aa, Artificial
  Peptide with targeting and/or antimicrobial activity
GWRLLLKKAEVKTVGKLALKHYL

SEQ ID NO: 2568 - protein, 26 aa, Artificial
  Peptide with targeting and/or antimicrobial activity
AGWGSIFKHIFKAGKFIHGAIQAHND

SEQ ID NO: 2569 - protein, 21 aa, Artificial
  Peptide with targeting and/or antimicrobial activity
GFWGKLFKLGLHGIGLLHLHL

SEQ ID NO: 2570 - protein, 19 aa, Artificial
  Peptide with targeting and/or antimicrobial activity
GWKKWLRKGAKHLGQAAIK

SEQ ID NO: 2571 - protein, 23 aa, Artificial
  Peptide with targeting and/or antimicrobial activity
GWKKWLRKGAKHLGQAAIKGLAS

SEQ ID NO: 2572 - protein, 24 aa, Artificial
  Peptide with targeting and/or antimicrobial activity
FLGLLFHGVHHVGKWIHGLIHGHH

SEQ ID NO: 2573 - protein, 20 aa, Artificial
  Peptide with targeting and/or antimicrobial activity
IIGPVLGLVGSALGGLLKKI

SEQ ID NO: 2574 - protein, 20 aa, Artificial
  Peptide with targeting and/or antimicrobial activity
IIGPVLGMVGSALGGLLKKI

SEQ ID NO: 2575 - protein, 17 aa, Artificial
  Peptide with targeting and/or antimicrobial activity
ILGPILGLVSNALGGLL

SEQ ID NO: 2576 - protein, 18 aa, Artificial
  Peptide with targeting and/or antimicrobial activity
IIGPVLGLVGKPLESLLE

SEQ ID NO: 2577 - protein, 18 aa, Artificial
  Peptide with targeting and/or antimicrobial activity
IIGPVLGLVGKPLESLLE

SEQ ID NO: 2578 - protein, 62 aa, Artificial
  Peptide with targeting and/or antimicrobial activity
NRWYCNSAAGGVGGAAGCVLAGYVGEAKENIAGEVRKGWGMAGGFTHNKACKSFPGSGWASG

SEQ ID NO: 2579 - protein, 20 aa, Artificial
  Peptide with targeting and/or antimicrobial activity
CRFCCRCCPRMRGCGLCCRF

SEQ ID NO: 2580 - protein, 22 aa, Artificial
  Peptide with targeting and/or antimicrobial activity
GIKCRFCCGCCTPGICGVCCRF

SEQ ID NO: 2581 - protein, 20 aa, Artificial
  Peptide with targeting and/or antimicrobial activity
QSHLSLCRWCCNCCRSNKGC

SEQ ID NO: 2582 - protein, 40 aa, Artificial
  Peptide with targeting and/or antimicrobial activity
MTPFWRGVSLRPIGASCRDDSECITRLCRKRRCSLSVAQE

SEQ ID NO: 2583 - protein, 29 aa, Artificial
  Peptide with targeting and/or antimicrobial activity
FAEPLPSEEEGESYSKEPPEMEKRYGGFM

SEQ ID NO: 2584 - protein, 38 aa, Artificial
  Peptide with targeting and/or antimicrobial activity
SFGLCRLRRGSCAHGRCRFPSIPIGRCSRFVQCCRRVW

SEQ ID NO: 2585 - protein, 37 aa, Artificial
  Peptide with targeting and/or antimicrobial activity
LLGDFFRKAREKIGEEFKRIVQRIKDFLRNLVPRTES

SEQ ID NO: 2586 - protein, 37 aa, Artificial
  Peptide with targeting and/or antimicrobial activity
SLGNFFRKARKKIGEEFKRIVQRIKDFLQHLIPRTEA

SEQ ID NO: 2587 - protein, 37 aa, Artificial
  Peptide with targeting and/or antimicrobial activity
RLGNFFRKAKKKIGRGLKKIGQKIKDFLGNLVPRTES

SEQ ID NO: 2588 - protein, 37 aa, Artificial
  Peptide with targeting and/or antimicrobial activity
RLGDILQKAREKIEGGLKKLVQKIKDFFGKFAPRTES

SEQ ID NO: 2589 - protein, 23 aa, Artificial
  Peptide with targeting and/or antimicrobial activity
GLVTSLIKGAGKLLGGLFGSVTG

SEQ ID NO: 2590 - protein, 23 aa, Artificial
  Peptide with targeting and/or antimicrobial activity
GLVTGLLKTAGKLLGDLFGSLTG

SEQ ID NO: 2591 - protein, 23 aa, Artificial
  Peptide with targeting and/or antimicrobial activity
GVVTDLLKTAGKLLGNLFGSLSG

SEQ ID NO: 2592 - protein, 23 aa, Artificial
  Peptide with targeting and/or antimicrobial activity
GVVTDLLKTAGKLLGNLVGSLSG

SEQ ID NO: 2593 - protein, 94 aa, Artificial
  Peptide with targeting and/or antimicrobial activity
PITYLDAILAAVRLLNQRISGPCILRLREAQPRPGWVGTLQRRREVSFLVEDGPCPPGVDCRSCEPGALQHCVGTVSIEQQPTAELRCRPLRPQ

SEQ ID NO: 2594 - protein, 67 aa, Artificial
  Peptide with targeting and/or antimicrobial activity
MRILYLLLSVLFVVLQGVAGQPYFSSPIHACRYQRGVCIPGPCRWPYYRVGSCGSGLKSCCVRNRWA

SEQ ID NO: 2595 - protein, 62 aa, Artificial
  Peptide with targeting and/or antimicrobial activity
MKILCFFIVLFVAVHGAVGFSRSPRYHMQCGYRGTFCTPGKCPYGNAYLGLCRPKYSCCRWL

SEQ ID NO: 2596 - protein, 66 aa, Artificial
  Peptide with targeting and/or antimicrobial activity
MQILPLLFAVLLLMLRAEPGLSLARGLPQDCERRGGFCSHKSCPPGIGRIGLCSKEDFCCRSRWYS

SEQ ID NO: 2597 - protein, 40 aa, Artificial
  Peptide with targeting and/or antimicrobial activity
MTPFWRGVSLRPVGASCRDNSECITMLCRKNRCFLRTASE

SEQ ID NO: 2598 - protein, 31 aa, Artificial
  Peptide with targeting and/or antimicrobial activity
GLGSILGKILNVAGKVGKTIGKVADAVGNKE

SEQ ID NO: 2599 - protein, 31 aa, Artificial
  Peptide with targeting and/or antimicrobial activity
GLGSFLKNAIKIAGKVGSTIGKVADAIGNKE

SEQ ID NO: 2600 - protein, 31 aa, Artificial
  Peptide with targeting and/or antimicrobial activity
GLGSFFKNAIKIAGKVGSTIGKVADAIGNKE

SEQ ID NO: 2601 - protein, 13 aa, Artificial
  Peptide with targeting and/or antimicrobial activity
FLPLLASLFSRLL

SEQ ID NO: 2602 - protein, 13 aa, Artificial
  Peptide with targeting and/or antimicrobial activity
FLPLIGKILGTIL

SEQ ID NO: 2603 - protein, 13 aa, Artificial
  Peptide with targeting and/or antimicrobial activity
FLPLLASLFSRLF

SEQ ID NO: 2604 - protein, 13 aa, Artificial
  Peptide with targeting and/or antimicrobial activity
FLPLLASLFSGLF

SEQ ID NO: 2605 - protein, 32 aa, Artificial
  Peptide with targeting and/or antimicrobial activity
GLFNVFKGLKTAGKHVAGSLLNQLKCKVSGGC

SEQ ID NO: 2606 - protein, 33 aa, Artificial
  Peptide with targeting and/or antimicrobial activity
GIFNVFKGALKTAGKHVAGSLLNQLKCKVSGEC

SEQ ID NO: 2607 - protein, 14 aa, Artificial
  Peptide with targeting and/or antimicrobial activity
SILPTIVSFLSKFL

SEQ ID NO: 2608 - protein, 14 aa, Artificial
  Peptide with targeting and/or antimicrobial activity
SILPTIVSFLTKFL

SEQ ID NO: 2609 - protein, 14 aa, Artificial
  Peptide with targeting and/or antimicrobial activity
FILPLIASFLSKFL

SEQ ID NO: 2610 - protein, 25 aa, Artificial
  Peptide with targeting and/or antimicrobial activity
SMISVLKNLGKVGLGFVACKVNKQC

SEQ ID NO: 2611 - protein, 20 aa, Artificial
  Peptide with targeting and/or antimicrobial activity
FLGGLMKIIPAAFCAVTKKC

SEQ ID NO: 2612 - protein, 31 aa, Artificial
  Peptide with targeting and/or antimicrobial activity
GLLLDTLKGAAKDIAGIALEKLKCKITGCKP

SEQ ID NO: 2613 - protein, 23 aa, Artificial
  Peptide with targeting and/or antimicrobial activity
GLLSGILGAGKHIVCGLTGCAKA

SEQ ID NO: 2614 - protein, 20 aa, Artificial
  Peptide with targeting and/or antimicrobial activity
ILGPVISTIGGVLGGLLKNL

SEQ ID NO: 2615 - protein, 39 aa, Artificial
  Peptide with targeting and/or antimicrobial activity
KVNANAIKKGGKAIGKGFKVISAASTAHDVYEHIKNRRH

SEQ ID NO: 2616 - protein, 43 aa, Artificial
  Peptide with targeting and/or antimicrobial activity
GKIPVKAIKKGGQIIGKALRGINIASTAHDIISQFKPKKKKNH

SEQ ID NO: 2617 - protein, 38 aa, Artificial
  Peptide with targeting and/or antimicrobial activity
KVPIGAIKKGGKIIKKGLGVIGAAGTAHEVYSHVKNRH

SEQ ID NO: 2618 - protein, 38 aa, Artificial
  Peptide with targeting and/or antimicrobial activity
KVPIGAIKKGGKIIKKGLGVLGAAGTAHEVYNHVRNRQ

SEQ ID NO: 2619 - protein, 38 aa, Artificial
  Peptide with targeting and/or antimicrobial activity
KVPIGAIKKGGKIIKKGLGVIGAAGTAHEVYSHVKNRQ

SEQ ID NO: 2620 - protein, 38 aa, Artificial
  Peptide with targeting and/or antimicrobial activity
KVPVGAIKKGGKAIKTGLGVVGAAGTAHEVYSHIRNRH

SEQ ID NO: 2621 - protein, 38 aa, Artificial
  Peptide with targeting and/or antimicrobial activity
KGIGSALKKGGKIIKGGLGALGAIGTGQQVYEHVQNRQ

SEQ ID NO: 2622 - protein, 47 aa, Artificial
  Peptide with targeting and/or antimicrobial activity
TTHSGKYYGNGVYCTKNKCTVDWAKATTCIAGMSIGGFLGGAIPGKC

SEQ ID NO: 2623 - protein, 43 aa, Artificial
  Peptide with targeting and/or antimicrobial activity
TKYYGNGVYCNSKKCWVDWGQASGCIGQTVVGGWLGGAIPGKC

SEQ ID NO: 2624 - protein, 43 aa, Artificial
  Peptide with targeting and/or antimicrobial activity
TKYYGNGVYCNSKKCWVDWGTAQGCIDVVIGQLGGGIPGKGKC

SEQ ID NO: 2625 - protein, 44 aa, Artificial
  Peptide with targeting and/or antimicrobial activity
KYYGNGVTCGKHSCSVDWGKATTCIINNGAMAWATGGHQGTHKC

SEQ ID NO: 2626 - protein, 43 aa, Artificial
  Peptide with targeting and/or antimicrobial activity
KSYGNGVHCNKKKCWVDWGSAISTIGNNSAANWATGGAAGWKS

SEQ ID NO: 2627 - protein, 43 aa, Artificial
  Peptide with targeting and/or antimicrobial activity
KYYGNGVSCNKKGCSVDWGKAIGIIGNNSAANLATGGAAGWKS

SEQ ID NO: 2628 - protein, 43 aa, Artificial
  Peptide with targeting and/or antimicrobial activity
KYYGNGLSCNKSGCSVDWSKAISIIGNNAVANLTTGGAAGWKS

SEQ ID NO: 2629 - protein, 43 aa, Artificial
  Peptide with targeting and/or antimicrobial activity
KNYGNGVHCTKKGCSVDWGYAWANIANNSVMNGLTGGNAGWHN

SEQ ID NO: 2630 - protein, 37 aa, Artificial
  Peptide with targeting and/or antimicrobial activity
TSYGNGVHCNKSKCWIDVSELETYKAGTVSNPKDILW

SEQ ID NO: 2631 - protein, 37 aa, Artificial
  Peptide with targeting and/or antimicrobial activity
KYYGNGVSCNSHGCSVNWGQAWTCGVNHLANGGHGVC

SEQ ID NO: 2632 - protein, 37 aa, Artificial
  Peptide with targeting and/or antimicrobial activity
KYYGNGVTCGKHSCSVNWGQAFSCSVSHLANFGHGKC

SEQ ID NO: 2633 - protein, 37 aa, Artificial
  Peptide with targeting and/or antimicrobial activity
KYYGNGLSCSKKGCTVNWGQAFSCGVNRVATAGHHKC

SEQ ID NO: 2634 - protein, 44 aa, Artificial
  Peptide with targeting and/or antimicrobial activity
ATRSYGNGVYCNNSKCWVNWGEAKENIAGIVISGWASGLAGMGH

SEQ ID NO: 2635 - protein, 43 aa, Artificial
  Peptide with targeting and/or antimicrobial activity
ATYYGNGLYCNKQKCWVDWNKASREIGKIIVNGWVQHGPWAPR

SEQ ID NO: 2636 - protein, 22 aa, Artificial
  Peptide with targeting and/or antimicrobial activity
GIGKFLKKAKKFGKAFVKILKK

SEQ ID NO: 2637 - protein, 24 aa, Artificial
  Peptide with targeting and/or antimicrobial activity
GIGKFLKKAKKGIGAVLKVLTTGL

SEQ ID NO: 2638 - protein, 21 aa, Artificial
  Peptide with targeting and/or antimicrobial activity
SSMKLSFRARAYGFRGPGPQL

SEQ ID NO: 2639 - protein, 13 aa, Artificial
  Peptide with targeting and/or antimicrobial activity
LLPIVGNLLNSLL

SEQ ID NO: 2640 - protein, 10 aa, Artificial
  Peptide with targeting and/or antimicrobial activity
LSPNLLKSLL

SEQ ID NO: 2641 - protein, 24 aa, Artificial
  Peptide with targeting and/or antimicrobial activity
FLPLAVSLAANFLPKLFCKITKKC

SEQ ID NO: 2642 - protein, 24 aa, Artificial
  Peptide with targeting and/or antimicrobial activity
FLPLLAGLAANFLPKIFCKITKRC

SEQ ID NO: 2643 - protein, 16 aa, Artificial
  Peptide with targeting and/or antimicrobial activity
FLPIVGKLLSGLSGLL

SEQ ID NO: 2644 - protein, 13 aa, Artificial
  Peptide with targeting and/or antimicrobial activity
FLPIVGRLISGLL

SEQ ID NO: 2645 - protein, 13 aa, Artificial
  Peptide with targeting and/or antimicrobial activity
FLPIIGQLLSGLL

SEQ ID NO: 2646 - protein, 13 aa, Artificial
  Peptide with targeting and/or antimicrobial activity
FLPIIAKVLSGLL

SEQ ID NO: 2647 - protein, 13 aa, Artificial
  Peptide with targeting and/or antimicrobial activity
FLPVIAGLLSKLF

SEQ ID NO: 2648 - protein, 13 aa, Artificial
  Peptide with targeting and/or antimicrobial activity
ILPLVGNLLNDLL

SEQ ID NO: 2649 - protein, 13 aa, Artificial
  Peptide with targeting and/or antimicrobial activity
ILPILGNLLNGLL

SEQ ID NO: 2650 - protein, 13 aa, Artificial
  Peptide with targeting and/or antimicrobial activity
FLPLVGKILSGLI

SEQ ID NO: 2651 - protein, 13 aa, Artificial
  Peptide with targeting and/or antimicrobial activity
FLSSIGKILGNLL

SEQ ID NO: 2652 - protein, 13 aa, Artificial
  Peptide with targeting and/or antimicrobial activity
FLSIIAKVLGSLF

SEQ ID NO: 2653 - protein, 21 aa, Artificial
  Peptide with targeting and/or antimicrobial activity
FLGSLIGAAIPAIKQLLGLKK

SEQ ID NO: 2654 - protein, 24 aa, Artificial
  Peptide with targeting and/or antimicrobial activity
FLPILASLAAKFGPKLFCLVTKKC

SEQ ID NO: 2655 - protein, 32 aa, Artificial
  Peptide with targeting and/or antimicrobial activity
QLKVDLWGTRSGIQPEQHSSGKSDVRRWRSRY

SEQ ID NO: 2656 - protein, 24 aa, Artificial
  Peptide with targeting and/or antimicrobial activity
FLPILASLAAKLGPKLFCLVTKKC

SEQ ID NO: 2657 - protein, 24 aa, Artificial
  Peptide with targeting and/or antimicrobial activity
FLPILASLAATLGPKLLCLITKKC

SEQ ID NO: 2658 - protein, 32 aa, Artificial
  Peptide with targeting and/or antimicrobial activity
GILSTFKGLAKGVAKDLAGNLLDKFKCKITGC

SEQ ID NO: 2659 - protein, 28 aa, Artificial
  Peptide with targeting and/or antimicrobial activity
GIMDSVKGLAKNLAGKLLDSLKCKITGC

SEQ ID NO: 2660 - protein, 24 aa, Artificial
  Peptide with targeting and/or antimicrobial activity
IIGLVSKGTCVLVKTVCKKVLKQG

SEQ ID NO: 2661 - protein, 36 aa, Artificial
  Peptide with targeting and/or antimicrobial activity
PDITKLNIKKLTKATCKVISKGASMCKVLFDKKKQE

SEQ ID NO: 2662 - protein, 37 aa, Artificial
  Peptide with targeting and/or antimicrobial activity
DVKGMKKAIKGILDCVIEKGYDKLAAKLKKVIQQLWE

SEQ ID NO: 2663 - protein, 21 aa, Artificial
  Peptide with targeting and/or antimicrobial activity
GLLDFVTGVGKDIFAQLIKQI

SEQ ID NO: 2664 - protein, 34 aa, Artificial
  Peptide with targeting and/or antimicrobial activity
KRFKKFFKKLKNSVKKRAKKFFKKPRVIGVSIPF

SEQ ID NO: 2665 - protein, 34 aa, Artificial
  Peptide with targeting and/or antimicrobial activity
KRFKKFFKKLKKSVKKRAKKFFKKPRVIGVSIPF

SEQ ID NO: 2666 - protein, 34 aa, Artificial
  Peptide with targeting and/or antimicrobial activity
KRFKKFFKKLKNSVKKRAKKFFKKPKVIGVTFPF

SEQ ID NO: 2667 - protein, 13 aa, Artificial
  Peptide with targeting and/or antimicrobial activity
FLSGIVGMLGKLF

SEQ ID NO: 2668 - protein, 13 aa, Artificial
  Peptide with targeting and/or antimicrobial activity
FLPIVTNLLSGLL

SEQ ID NO: 2669 - protein, 13 aa, Artificial
  Peptide with targeting and/or antimicrobial activity
FLSHIAGFLSNLF

SEQ ID NO: 2670 - protein, 20 aa, Artificial
  Peptide with targeting and/or antimicrobial activity
EWGRRCCGWGPGRRYCVRWC

SEQ ID NO: 2671 - protein, 20 aa, Artificial
  Peptide with targeting and/or antimicrobial activity
QYGRRCCNWGPGRRYCKRWC

SEQ ID NO: 2672 - protein, 45 aa, Artificial
  Peptide with targeting and/or antimicrobial activity
QQCGRQAGNRRCANNLCCSQYGYCGRTNEYCCTSQGCQSQCRRCG

SEQ ID NO: 2673 - protein, 38 aa, Artificial
  Peptide with targeting and/or antimicrobial activity
AGCIKNGGRCNASAGPPYCCSSYCFQIAGQSYGVCKNR

SEQ ID NO: 2674 - protein, 37 aa, Artificial
  Peptide with targeting and/or antimicrobial activity
ACIKNGGRCVASGGPPYCCSNYCLQIAGQSYGVCKKH

SEQ ID NO: 2675 - protein, 37 aa, Artificial
  Peptide with targeting and/or antimicrobial activity
GYGCPFNQYQCHSHCRGIRGYKGGYCTGRFKQTCKCY

SEQ ID NO: 2676 - protein, 37 aa, Artificial
  Peptide with targeting and/or antimicrobial activity
GYGCPFNQYQCHSHCSGIRGYKGGYCKGLFKQTCNCY

SEQ ID NO: 2677 - protein, 37 aa, Artificial
  Peptide with targeting and/or antimicrobial activity
GFGCPFNQYECHAHCSGVPGYKGGYCKGLFKQTCNCY

SEQ ID NO: 2678 - protein, 58 aa, Artificial
  Peptide with targeting and/or antimicrobial activity
IYFIADKMGIQLAPAWYQDIVNWVSAGGTLTTGFAIIVGVTVPAWIAEAAAAFGIASA

SEQ ID NO: 2679 - protein, 80 aa, Artificial
  Peptide with targeting and/or antimicrobial activity
ASLQFLPIAHMAKEFGIPAAVAGTVINVVEAGGWVTTIVSILTAVGSGGLSLLAAAGRESIKAYLKKEIKKKGKRAVIAW

SEQ ID NO: 2680 - protein, 58 aa, Artificial; identical to SEQ ID NO: 2547
  Peptide with targeting and/or antimicrobial activity

SEQ ID NO: 2681 - protein, 70 aa, Artificial
  Peptide with targeting and/or antimicrobial activity
LAGYTGIASGTAKKVVDAIDKGAAAFVIISIISTVISAGALGAVSASADFIILTVKNYISRNLKAQAVIW

SEQ ID NO: 2682 - protein, 58 aa, Artificial
  Peptide with targeting and/or antimicrobial activity
IYWIADQFGIHLATGTARKLLDAVASGASLGTAFAAILGVTLPAWALAAAGALGATAA

SEQ ID NO: 2683 - protein, 40 aa, Artificial
  Peptide with targeting and/or antimicrobial activity
ATCDLLSGTGINHSACAAHCLLRGNRGGYCNRKGVCVCRN

SEQ ID NO: 2684 - protein, 19 aa, Artificial
  Peptide with targeting and/or antimicrobial activity
RNCESLSHRFKGPCTRDSN

SEQ ID NO: 2685 - protein, 63 aa, Artificial
  Peptide with targeting and/or antimicrobial activity
GSNFCDSKCKLRCSKAGLADRCLKYCGICCEECKCVPSGTYGNKHECPCYRDKKNSKGKSKCP

SEQ ID NO: 2686 - protein, 66 aa, Artificial
  Peptide with targeting and/or antimicrobial activity
YSYKKIDCGGACAARCRLSSRPRLCNRACGTCCARCNCVPPGTSGNTETCPCYASLTTHGNKRKCP

SEQ ID NO: 2687 - protein, 52 aa, Artificial
  Peptide with targeting and/or antimicrobial activity
GIFSSRKCKTPSKTFKGICTRDSNCDTSCRYEGYPAGDCKGIRRRCMCSKPC

SEQ ID NO: 2688 - protein, 18 aa, Artificial
  Peptide with targeting and/or antimicrobial activity
GIFSNMYARTPAGYFRGP

SEQ ID NO: 2689 - protein, 34 aa, Artificial
  Peptide with targeting and/or antimicrobial activity
ITSISLCTPGCKTGVLMGCNLKTATCNCSVHVSK

SEQ ID NO: 2690 - protein, 44 aa, Artificial
  Peptide with targeting and/or antimicrobial activity
YSRCQLQGFNCVVRSYGLPTIPCCRGLTCRSYFPGSTYGRCQRF

SEQ ID NO: 2691 - protein, 41 aa, Artificial
  Peptide with targeting and/or antimicrobial activity
DYDWSLRGPPKCATYGQKCRTWSPRNCCWNLRCKAFRCRPR

SEQ ID NO: 2692 - protein, 20 aa, Artificial
  Peptide with targeting and/or antimicrobial activity
SWKSMAKKLKEYMEKLKQRA

SEQ ID NO: 2693 - protein, 20 aa, Artificial
  Peptide with targeting and/or antimicrobial activity
SWASMAKKLKEYMEKLKQRA

SEQ ID NO: 2694 - protein, 24 aa, Artificial
  Peptide with targeting and/or antimicrobial activity
GLKDKFKSMGEKLKQYIQTWKAKF

SEQ ID NO: 2695 - protein, 24 aa, Artificial
  Peptide with targeting and/or antimicrobial activity
SLKDKVKSMGEKLKQYIQTWKAKF

SEQ ID NO: 2696 - protein, 28 aa, Artificial
  Peptide with targeting and/or antimicrobial activity
GFFGKMKEYFKKFGASFKRRFANLKKRL

SEQ ID NO: 2697 - protein, 33 aa, Artificial
  Peptide with targeting and/or antimicrobial activity
QAFQTFKPDWNKIRYDAMKMQTSLGQMKKRFNL

SEQ ID NO: 2698 - protein, 34 aa, Artificial
  Peptide with targeting and/or antimicrobial activity
GETFDKLKEKLKTFYQKLVEKAEDLKGDLKAKLS

SEQ ID NO: 2699 - protein, 29 aa, Artificial
  Peptide with targeting and/or antimicrobial activity
VCGETCFGGTCNTPGCSCTWPICTRDGLP

SEQ ID NO: 2700 - protein, 35 aa, Artificial; identical to SEQ ID NO: 1957
  Peptide with targeting and/or antimicrobial activity

SEQ ID NO: 2701 - protein, 34 aa, Artificial
  Peptide with targeting and/or antimicrobial activity
KPYCSCKWRCGIGEEEKGICHKFPIVTYVCCRRP

SEQ ID NO: 2702 - protein, 41 aa, Artificial
  Peptide with targeting and/or antimicrobial activity
DTLACRQSHGSCSFVACRAPSVDIGTCRGGKLKCCKWAPSS

SEQ ID NO: 2703 - protein, 41 aa, Artificial
  Peptide with targeting and/or antimicrobial activity
DTVACRIQGNFCRAGACPPTFTISGQCHGGLLNCCAKIPAQ

SEQ ID NO: 2704 - protein, 38 aa, Artificial
  Peptide with targeting and/or antimicrobial activity
IATQCRIRGGFCRVGSCRFPHIAIGKCATFISCCGRAY

SEQ ID NO: 2705 - protein, 39 aa, Artificial
  Peptide with targeting and/or antimicrobial activity
SIWGDIGQGVGKAAYWVGKAMGNMSDVNQASRINRKKKH

SEQ ID NO: 2706 - protein, 39 aa, Artificial
  Peptide with targeting and/or antimicrobial activity
ESVFSKIGNAVGPAAYWILKGLGNMSDVNQADRINRKKH

SEQ ID NO: 2707 - protein, 26 aa, Artificial
  Peptide with targeting and/or antimicrobial activity
NKLAYNMGHYAGKATIFGLAAWALLA

SEQ ID NO: 2708 - protein, 37 aa, Artificial
  Peptide with targeting and/or antimicrobial activity
KWKIFKKIEHMGQNIRDGLIKAGPAVQVVGQAATIYK

SEQ ID NO: 2709 - protein, 27 aa, Artificial
  Peptide with targeting and/or antimicrobial activity
KILRGLCKKIMRSFLRRISWDILTGKK

SEQ ID NO: 2710 - protein, 28 aa, Artificial
  Peptide with targeting and/or antimicrobial activity
LTTKLWSSWGYYLGKKARWNLKHPYVQF

SEQ ID NO: 2711 - protein, 60 aa, Artificial
  Peptide with targeting and/or antimicrobial activity
LVAYGIAQGTAEKVVSLINAGLTVGSIISILGGVTVGLSGVFTAVKAAIAKQGIKKAIQL

SEQ ID NO: 2712 - protein, 48 aa, Artificial
  Peptide with targeting and/or antimicrobial activity
NRWGDTVLSAASGAGTGIKACKSFGPWGMAICGVGGAAIGGYFGYTHN

SEQ ID NO: 2713 - protein, 59 aa, Artificial
  Peptide with targeting and/or antimicrobial activity
YSSKDCLKDIGKGIGAGTVAGAAGGGLAAGLGAIPGAFVGAHFGVIGGSAACIGGLLGN

SEQ ID NO: 2714 - protein, 62 aa, Artificial
  Peptide with targeting and/or antimicrobial activity
YSGKDCLKDMGGYALAGAGSGALWGAPAGGVGALPGAFVGAHVGAIAGGFACMGGMIGNKFN

SEQ ID NO: 2715 - protein, 45 aa, Artificial
  Peptide with targeting and/or antimicrobial activity
KRGPNCVGNFLGGLFAGAAAGVPLGPAGIVGGANLGMVGGALTCL

SEQ ID NO: 2716 - protein, 45 aa, Artificial; identical to SEQ ID NO: 2715
  Peptide with targeting and/or antimicrobial activity

SEQ ID NO: 2717 - protein, 44 aa, Artificial
  Peptide with targeting and/or antimicrobial activity
KVSGGEAVAAIGICATASAAIGGLAGATLVTPYCVGTWGLIRSH

SEQ ID NO: 2718 - protein, 33 aa, Artificial
  Peptide with targeting and/or antimicrobial activity
GMSGYIQGIPDFLKGYLHGISAANKHKKGRLGY

SEQ ID NO: 2719 - protein, 21 aa, Artificial
  Peptide with targeting and/or antimicrobial activity
TTPACFTIGLGVGALFSAKFC

SEQ ID NO: 2720 - protein, 30 aa, Artificial
  Peptide with targeting and/or antimicrobial activity
FNRGGYNFGKSVRHVVDAIGSVAGILKSIR

SEQ ID NO: 2721 - protein, 25 aa, Artificial
  Peptide with targeting and/or antimicrobial activity
GAWKNFWSSLRKGFYDGEAGRAIRR

SEQ ID NO: 2722 - protein, 43 aa, Artificial
  Peptide with targeting and/or antimicrobial activity
NGVYCNKQKCWVDWSRARSEIIDRGVKAYVNGFTKVLGGIGGR

SEQ ID NO: 2723 - protein, 23 aa, Artificial
  Peptide with targeting and/or antimicrobial activity
NPKVAHCASQIGRSTAWGAVSGA

SEQ ID NO: 2724 - protein, 30 aa, Artificial
  Peptide with targeting and/or antimicrobial activity
AYPGNGVHCGKYSCTVDKQTAIGNIGNNAA

SEQ ID NO: 2725 - protein, 70 aa, Artificial
  Peptide with targeting and/or antimicrobial activity
FTPSVSFSQNGGVVEAAAQRGYIYKKYPKGAKVPNKVKMLVNIRGKQTMRTCYLMSWTASSRTAKYYYYI

SEQ ID NO: 2726 - protein, 44 aa, Artificial
  Peptide with targeting and/or antimicrobial activity
ATYYGNGLYCNKEKCWVDWNQAKGEIGKIIVNGWVNHGPWAPRR

SEQ ID NO: 2727 - protein, 44 aa, Artificial; identical to SEQ ID NO: 2726
  Peptide with targeting and/or antimicrobial activity

SEQ ID NO: 2728 - protein, 53 aa, Artificial
  Peptide with targeting and/or antimicrobial activity
ENDHRMPNNLNRPNNLSKGGAKCGAAIAGGLFGIPKGPLAWAAGLANVYSKCN

SEQ ID NO: 2729 - protein, 58 aa, Artificial
  Peptide with targeting and/or antimicrobial activity
KTYYGTNGVHCTKKSLWGKVRLKNVIPGTLCRKQSLPIKQDLKILLGWATGAFGKTFH

SEQ ID NO: 2730 - protein, 34 aa, Artificial
  Peptide with targeting and/or antimicrobial activity
MNFLKNGIAKWMTGAELQAYKKKYGCLPWEKISC

SEQ ID NO: 2731 - protein, 44 aa, Artificial
  Peptide with targeting and/or antimicrobial activity
MLAKIKAMIKKFPNPYTLAAKLTTYEINWYKQQYGRYPWERPVA

SEQ ID NO: 2732 - protein, 44 aa, Artificial
  Peptide with targeting and/or antimicrobial activity
APAGLVAKFGRPIVKKYYKQIMQFIGEGSAINKIIPWIARMWRT

SEQ ID NO: 2733 - protein, 44 aa, Artificial
  Peptide with targeting and/or antimicrobial activity
MGAIAKLVAKFGWPIVKKYYKQIMQFIGEGWAINKIIEWIKKHI

SEQ ID NO: 2734 - protein, 44 aa, Artificial
  Peptide with targeting and/or antimicrobial activity
MGAIAKLVAKFGWPIVKKYYKQIMQFIGEGWAINKIIDWIKKHI

SEQ ID NO: 2735 - protein, 36 aa, Artificial
  Peptide with targeting and/or antimicrobial activity
SDCNINSNTAADVILCFNQVGSCALCSPTLVGGPVP

SEQ ID NO: 2736 - protein, 76 aa, Artificial
  Peptide with targeting and/or antimicrobial activity
DIDITGCSACKYAAGQVCTIGCSAAGGFICGLLGITIPVAGLSCLGFVEIVCTVADEYSGCGDAVAKEACNRAGLC

SEQ ID NO: 2737 - protein, 30 aa, Artificial
  Peptide with targeting and/or antimicrobial activity
CSTNTFSLSDYWGNNGAWCTLTHECMAWCK

SEQ ID NO: 2738 - protein, 22 aa, Artificial
  Peptide with targeting and/or antimicrobial activity
KRGSGWIATITDDCPNSVFVCC

SEQ ID NO: 2739 - protein, 44 aa, Artificial; identical to SEQ ID NO: 2726
  Peptide with targeting and/or antimicrobial activity

SEQ ID NO: 2740 - protein, 44 aa, Artificial; identical to SEQ ID NO: 2726
  Peptide with targeting and/or antimicrobial activity

SEQ ID NO: 2741 - protein, 35 aa, Artificial
  Peptide with targeting and/or antimicrobial activity
LSCDEGMLAVGGLGAVGGPWGAAVGVLVGAALYCF

SEQ ID NO: 2742 - protein, 42 aa, Artificial
  Peptide with targeting and/or antimicrobial activity
KYYGNGVHCGKKTCYVDWGQATASIGKIIVNGWTQHGPWAHR

SEQ ID NO: 2743 - protein, 25 aa, Artificial
  Peptide with targeting and/or antimicrobial activity
GGGVIQTISHECRMNSWQFLFTCCS

SEQ ID NO: 2744 - protein, 27 aa, Artificial
  Peptide with targeting and/or antimicrobial activity
KGGSGVIHTISHECNMNSWQFVFTCCS

SEQ ID NO: 2745 - protein, 27 aa, Artificial
  Peptide with targeting and/or antimicrobial activity
KGGSGVIHTISHEVIYNSWNFVFTCCS

SEQ ID NO: 2746 - protein, 27 aa, Artificial
  Peptide with targeting and/or antimicrobial activity
KKKSGVIPTVSHDCHMNSFQFVFTCCS

SEQ ID NO: 2747 - protein, 26 aa, Artificial
  Peptide with targeting and/or antimicrobial activity
GKNGVFKTISHECHLNTWAFLATCCS

SEQ ID NO: 2748 - protein, 8 aa, Artificial
  Peptide with targeting and/or antimicrobial activity
PFKLSLHL

SEQ ID NO: 2749 - protein, 9 aa, Artificial
  Peptide with targeting and/or antimicrobial activity
TPFKLSLHL

SEQ ID NO: 2750 - protein, 9 aa, Artificial
  Peptide with targeting and/or antimicrobial activity
EPFKLSLHL

SEQ ID NO: 2751 - protein, 93 aa, Artificial
  Peptide with targeting and/or antimicrobial activity
EFRGSIVIQGTKEGKSRPSLDIDYKQRVYDKNGMTGDAYGGLNIRPGQPSRQHAGFEFGKEYKNGFIKGQSEVQRGPGGRLSPYFGINGGFRF

SEQ ID NO: 2752 - protein, 23 aa, Artificial
  Peptide with targeting and/or antimicrobial activity
GFRDVLKGAAKAFVKTVAGHIAN

SEQ ID NO: 2753 - protein, 24 aa, Artificial
  Peptide with targeting and/or antimicrobial activity
GFRDVLKGAAKAFVKTVAGHIANI

SEQ ID NO: 2754 - protein, 24 aa, Artificial
  Peptide with targeting and/or antimicrobial activity
GIKDWIKGAAKKLIKTVASNIANQ

SEQ ID NO: 2755 - protein, 24 aa, Artificial
  Peptide with targeting and/or antimicrobial activity
GFKDWIKGAAKKLIKTVASSIANQ

SEQ ID NO: 2756 - protein, 19 aa, Artificial
  Peptide with targeting and/or antimicrobial activity
GFKDLLKGAAKALVKTVLF

SEQ ID NO: 2757 - protein, 7 aa, Artificial
  Peptide with targeting and/or antimicrobial activity
MRTGNAD

SEQ ID NO: 2758 - protein, 43 aa, Artificial
  Peptide with targeting and/or antimicrobial activity
VGIGGGGGGGGGGSCGGQGGGCGGCSNGCSGGNGGSGGSGSHI

SEQ ID NO: 2759 - protein, 88 aa, Artificial
  Peptide with targeting and/or antimicrobial activity
ASGRDIAMAIGTLSGQFVAGGIGAAAGGVAGGAIYDYASTHKPNPAMSPSGLGGTIKQKPEGIPSEAWNYAAGRLCNWSPNNLSDVCL

SEQ ID NO: 2760 - protein, 90 aa, Artificial
  Peptide with targeting and/or antimicrobial activity
GDVNWVDVGKTVATNGAGVIGGAFGAGLCGPVCAGAFAVGSSAAVAALYDAAGNSNSAKQKPEGLPPEAWNYAEGRMCNWSPNNLSDVCL

SEQ ID NO: 2761 - protein, 77 aa, Artificial
  Peptide with targeting and/or antimicrobial activity
DGNDGQAELIAIGSLAGTFISPGFGSIAGAYIGDKVHSWATTATVSPSMSPSGIGLSSQFGSGRGTSSASSSAGSGS

SEQ ID NO: 2762 - protein, 60 aa, Artificial
  Peptide with targeting and/or antimicrobial activity
GGAPATSANAAGAAAIVGALAGIPGGPLGVVVGAVSAGLTTGIGSTVGSGSASSSAGGGS

SEQ ID NO: 2763 - protein, 62 aa, Artificial
  Peptide with targeting and/or antimicrobial activity
MNLNGLPASTNVIDLRGKDMGTYIDANGACWAPDTPSIIMYPGGSGPSYSMSSSTSSANSGS

SEQ ID NO: 2764 - protein, 19 aa, Artificial
  Peptide with targeting and/or antimicrobial activity
  mod_res (1)..(1): Xaa is Aib
  mod_res (3)..(3): Xaa is Aib
  mod_res (5)..(5): Xaa is Aib
  mod_res (8)..(8): Xaa is Aib
  mod_res (10)..(10): Xaa is Aib
  mod_res (12)..(13): Xaa is Aib
  mod_res (16)..(17): Xaa is Aib
XAXAXAQXFXGXXPVXXEE

SEQ ID NO: 2765 - protein, 20 aa, Artificial
  Peptide with targeting and/or antimicrobial activity
  mod_res (1)..(1): Aib
  mod_res (3)..(3): Aib
  mod_res (5)..(5): Aib
  mod_res (8)..(8): Aib
  mod_res (10)..(10): Aib
  mod_res (13)..(13): Aib
  mod_res (16)..(17): Aib
XPXAXAQXVXGLXPVXXEQF

SEQ ID NO: 2766 - protein, 20 aa, Artificial
  Peptide with targeting and/or antimicrobial activity
  mod_res (1)..(1): Aib
  mod_res (3)..(3): Aib
  mod_res (5)..(5): Aib
  mod_res (8)..(8): Aib
  mod_res (10)..(10): Aib
  mod_res (13)..(13): Aib
  mod_res (16)..(17): Aib
XPXAXAQXVXGLXPVXXQQF

SEQ ID NO: 2767 - protein, 20 aa, Artificial
  Peptide with targeting and/or antimicrobial activity
  mod_res (1)..(1): Aib
  mod_res (3)..(3): Aib
  mod_res (5)..(6): Aib
  mod_res (8)..(8): Aib
  mod_res (10)..(10): Aib
  mod_res (13)..(13): Aib
  mod_res (16)..(17): Aib
XPXAXXQXVXGLXPVXXEQF

SEQ ID NO: 2768 - protein, 15 aa, Artificial
  Peptide with targeting and/or antimicrobial activity
  mod_res (3)..(4): Aib
  misc_feature (6)..(6): Xaa can be any naturally occurring amino acid
  mod_res (8)..(10): Aib
  mod_res (13)..(13): Aib
WAXXLXQXXXQLXQL

SEQ ID NO: 2769 - protein, 15 aa, Artificial
  Peptide with targeting and/or antimicrobial activity
  mod_res (3)..(4): Aib
  mod_res (6)..(6): Aib
  mod_res (9)..(10): Aib
  mod_res (13)..(13): Aib
WAXXLXQAXXQLXQL

SEQ ID NO: 2770 - protein, 15 aa, Artificial
  Peptide with targeting and/or antimicrobial activity
  mod_res (3)..(4): Aib
  mod_res (6)..(6): Aib
  mod_res (8)..(8): Aib
  mod_res (10)..(10): Aib
  mod_res (13)..(13): Aib
WAXXLXQXAXQLXQL

SEQ ID NO: 2771 - protein, 15 aa, Artificial
  Peptide with targeting and/or antimicrobial activity
  mod_res (3)..(4): Aib
  misc_feature (6)..(6): Xaa can be any naturally occurring amino acid
  mod_res (8)..(9): Aib
  mod_res (13)..(13): Aib
WAXXLXQXXAQLXQL

SEQ ID NO: 2772 - protein, 15 aa, Artificial
  Peptide with targeting and/or antimicrobial activity
  mod_res (3)..(4): Aib
  mod_res (6)..(6): Aib
  mod_res (9)..(10): Aib
WAXXLXQAXXQLAQL

SEQ ID NO: 2773 - protein, 15 aa, Artificial
  Peptide with targeting and/or antimicrobial activity
  mod_res (3)..(4): Aib
  mod_res (6)..(6): Aib
  mod_res (8)..(8): Aib
  mod_res (13)..(13): Aib
WAXXLXQXAAQLXQL

SEQ ID NO: 2774 - protein, 15 aa, Artificial
  Peptide with targeting and/or antimicrobial activity
  mod_res (3)..(4): Aib
  mod_res (6)..(6): Aib
  mod_res (8)..(9): Aib
WAXXLXQXXAQLAQL

SEQ ID NO: 2775 - protein, 15 aa, Artificial
  Peptide with targeting and/or antimicrobial activity
  mod_res (3)..(4): Aib
  mod_res (6)..(6): Aib
  mod_res (10)..(10): Aib
  mod_res (13)..(13): Aib
WAXXLXQAAXQLXQL

SEQ ID NO: 2776 - protein, 16 aa, Artificial
  Peptide with targeting and/or antimicrobial activity
  mod_res (2)..(4): Aib
  mod_res (5)..(5): Isovaline
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXGLXXXQXXXPF

SEQ ID NO: 2777 - protein, 16 aa, Artificial
  Peptide with targeting and/or antimicrobial activity
  mod_res (2)..(4): Aib
  mod_res (5)..(5): Isovaline
  mod_res (8)..(9): Aib
  mod_res (10)..(10): Hydroxyproline
  mod_res (12)..(12): Isovaline
  mod_res (14)..(14): Aib
FXXXXGLXXXQXPXPF

SEQ ID NO: 2778 - protein, 16 aa, Artificial
  Peptide with targeting and/or antimicrobial activity
  mod_res (2)..(5): Aib
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXGLXXXQXXXPF

SEQ ID NO: 2779 - protein, 16 aa, Artificial
  Peptide with targeting and/or antimicrobial activity
  mod_res (2)..(4): Aib
  mod_res (5)..(5): Isovaline
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXGLXXXQXXXPF

SEQ ID NO: 2780 - protein, 16 aa, Artificial
  Peptide with targeting and/or antimicrobial activity
  mod_res (2)..(4): Aib
  mod_res (5)..(5): Isovaline
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXALXXXQXXXPF

SEQ ID NO: 2781 - protein, 16 aa, Artificial
  Peptide with targeting and/or antimicrobial activity
  mod_res (2)..(5): Aib
  mod_res (8)..(9): Aib
  mod_res (10)..(10): Hydroxyproline
  mod_res (12)..(12): Aib
  mod_res (13)..(13): Hydroxyproline
  mod_res (14)..(14): Aib
FXXXXGLXXXQXXXPF

SEQ ID NO: 2782 - protein, 16 aa, Artificial
  Peptide with targeting and/or antimicrobial activity
  mod_res (3)..(3): Aib
  misc_feature (4)..(4): Xaa can be any naturally occurring amino acid
  mod_res (5)..(5): Aib
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
FAXXXGLXXXQXXXPF

SEQ ID NO: 2783 - protein, 16 aa, Artificial
  Peptide with targeting and/or antimicrobial activity
  mod_res (2)..(4): Aib
  mod_res (5)..(5): Isovaline
  mod_res (8)..(9): Aib
  mod_res (10)..(10): Hydroxyproline
  mod_res (12)..(12): Aib
  mod_res (13)..(13): Hydroxyproline
  mod_res (14)..(14): Aib
FXXXXGLXXXQXXXPF

SEQ ID NO: 2784 - protein, 16 aa, Artificial
  Peptide with targeting and/or antimicrobial activity
  mod_res (2)..(2): Aib
  mod_res (4)..(4): Aib
  mod_res (5)..(5): Isovaline
  mod_res (8)..(9): Aib
  mod_res (10)..(10): Hydroxyproline
  mod_res (12)..(12): Aib
  mod_res (13)..(13): Hydroxyproline
  mod_res (14)..(14): Aib
FXAXXGLXXXQXXXPF

SEQ ID NO: 2785 - protein, 16 aa, Artificial
  Peptide with targeting and/or antimicrobial activity
  mod_res (2)..(4): Aib
  mod_res (5)..(5): Isovaline
  mod_res (8)..(8): Isovaline
  mod_res (9)..(9): Aib
  mod_res (10)..(10): Hydoxyproline
  mod_res (12)..(12): Aib
  mod_res (13)..(13): Hydoxyproline
  mod_res (14)..(14): Aib
FXXXXGLXXXQXXXPF

SEQ ID NO: 2786 - protein, 16 aa, Artificial
  Peptide with targeting and/or antimicrobial activity
  mod_res (2)..(5): Aib
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXALXXXQXXXPF

SEQ ID NO: 2787 - protein, 16 aa, Artificial
  Peptide with targeting and/or antimicrobial activity
  mod_res (2)..(5): Aib
  mod_res (9)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXGLAXXQXXXPF

SEQ ID NO: 2788 - protein, 16 aa, Artificial
  Peptide with targeting and/or antimicrobial activity
  mod_res (2)..(5): Aib
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
VXXXXGLXXXQXXXPF

SEQ ID NO: 2789 - protein, 16 aa, Artificial
  Peptide with targeting and/or antimicrobial activity
  mod_res (2)..(4): Aib
  mod_res (8)..(9): Aib
  mod_res (10)..(10): Hydroxyproline
  mod_res (11)..(11): Isovaline
  misc_feature (12)..(12): Xaa can be any naturally occurring amino acid
  mod_res (13)..(13): Hydroxyproline
  mod_res (14)..(14): Aib
VXXXVGLXXXQXXXPF

SEQ ID NO: 2790 - protein, 16 aa, Artificial
  Peptide with targeting and/or antimicrobial activity
  mod_res (2)..(5): Aib
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
LXXXXGLXXXQXXXPF

SEQ ID NO: 2791 - protein, 16 aa, Artificial
  Peptide with targeting and/or antimicrobial activity
  mod_res (2)..(4): Aib
  mod_res (5)..(5): Isovaline
  mod_res (8)..(9): Aib
  mod_res (10)..(10): Hydroxyproline
  mod_res (12)..(12): Isovaline
  mod_res (13)..(13): Hydroxyproline
  mod_res (14)..(14): Aib
LXXXXGLXXXQXXXPF

SEQ ID NO: 2792 - protein, 20 aa, Artificial
  Peptide with targeting and/or antimicrobial activity
  mod_res (1)..(1): Aib
  misc_feature (3)..(3): Xaa can be any naturally occurring amino acid
  mod_res (5)..(5): Aib
  mod_res (8)..(8): Aib
  mod_res (10)..(10): Aib
  mod_res (13)..(13): Aib
  mod_res (16)..(17): Aib
XPXAXAQXVXGLXPVXXQQF

SEQ ID NO: 2793 - protein, 20 aa, Artificial
  Peptide with targeting and/or antimicrobial activity
  mod_res (1)..(1): Aib
  mod_res (3)..(3): Aib
  mod_res (5)..(5): Aib
  mod_res (8)..(8): Aib
  mod_res (10)..(10): Aib
  mod_res (13)..(13): Aib
  mod_res (16)..(16): Aib
  mod_res (17)..(17): Isovaline
XPXAXAQXVXGLXPVXXQQF

SEQ ID NO: 2794 - protein, 20 aa, Artificial
  Peptide with targeting and/or antimicrobial activity
  mod_res (1)..(1): Aib
  mod_res (3)..(3): Aib
  mod_res (5)..(6): Aib
  mod_res (8)..(8): Aib
  mod_res (10)..(10): Aib
  mod_res (13)..(13): Aib
  mod_res (16)..(16): Aib
  mod_res (17)..(17): Isovaline
XPXAXXQXVXGLXPVXXQQF

SEQ ID NO: 2795 - protein, 15 aa, Artificial
  Peptide with targeting and/or antimicrobial activity
  mod_res (2)..(4): Aib
  mod_res (8)..(9): Aib
  mod_res (10)..(10): Hydroxyproline
  misc_feature (12)..(12): Xaa can be any naturally occurring amino acid
  mod_res (13)..(13): Hydroxyproline
  mod_res (14)..(14): Aib
VXXXVGLXXXQXXXF

SEQ ID NO: 2796 - protein, 15 aa, Artificial
  Peptide with targeting and/or antimicrobial activity
  mod_res (2)..(4): Aib
  mod_res (9)..(9): Aib
  mod_res (10)..(10): Hydroxyproline
  mod_res (12)..(12): Aib
  mod_res (13)..(13): Hydroxyproline
  mod_res (14)..(14): Aib
VXXXVGLVXXQXXXF

SEQ ID NO: 2797 - protein, 15 aa, Artificial
  Peptide with targeting and/or antimicrobial activity
  mod_res (2)..(4): Aib
  mod_res (8)..(9): Aib
  mod_res (10)..(10): Hydroxyproline
  mod_res (12)..(12): Aib
  mod_res (13)..(13): Hydroxyproline
  mod_res (14)..(14): Aib
VXXXVGLXXXQXXXF

SEQ ID NO: 2798 - protein, 14 aa, Artificial
  Peptide with targeting and/or antimicrobial activity
  mod_res (2)..(3): Aib
  mod_res (7)..(8): Aib
  mod_res (9)..(9): Hydroxyproline
  mod_res (11)..(11): Aib
  mod_res (12)..(12): Hydroxyproline
  mod_res (13)..(13): Aib
VXXVGLXXXQXXXF

SEQ ID NO: 2799 - protein, 19 aa, Artificial
  Peptide with targeting and/or antimicrobial activity
  mod_res (2)..(2): Aib
  mod_res (4)..(4): Aib
  mod_res (5)..(5): Isovaline
  mod_res (9)..(10): Aib
  mod_res (13)..(13): Aib
  mod_res (15)..(17): Aib
FXAXXLQGXXAAXPXXXQW

SEQ ID NO: 2800 - protein, 16 aa, Artificial
  Peptide with targeting and/or antimicrobial activity
  mod_res (2)..(5): Aib
  mod_res (8)..(8): Isovaline
  mod_res (9)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXGLXXXQXXXPF

SEQ ID NO: 2801 - protein, 16 aa, Artificial
  Peptide with targeting and/or antimicrobial activity
  mod_res (2)..(5): Aib
  mod_res (8)..(8): Isovaline
  mod_res (9)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXALXXXQXXXPF

SEQ ID NO: 2802 - protein, 16 aa, Artificial
  Peptide with targeting and/or antimicrobial activity
  mod_res (2)..(4): Aib
  misc_feature (5)..(5): Xaa can be any naturally occurring amino acid
  mod_res (8)..(8): Isovaline
  mod_res (9)..(9): Aib
  mod_res (10)..(10): Hydroxyproline
  mod_res (12)..(12): Isovaline
  mod_res (13)..(13): Hydroxyproline
  mod_res (14)..(14): Aib
FXXXXGLXXXQXXXPF

SEQ ID NO: 2803 - protein, 16 aa, Artificial
  Peptide with targeting and/or antimicrobial activity
  mod_res (2)..(5): Aib
  mod_res (8)..(8): Isovaline
  mod_res (9)..(9): Aib
  mod_res (10)..(10): Hydroxyproline
  mod_res (12)..(12): Aib
  mod_res (13)..(13): Hydroxyproline
  mod_res (14)..(14): Aib
FXXXXGLXXXQXXXPF

SEQ ID NO: 2804 - protein, 16 aa, Artificial
  Peptide with targeting and/or antimicrobial activity
  mod_res (2)..(5): Aib
  mod_res (8)..(9): Aib
  mod_res (10)..(10): Hydroxyproline
  mod_res (12)..(12): Aib
  mod_res (13)..(13): Hydroxyproline
  mod_res (14)..(14): Aib
FXXXXGLXXXQXXXPF

SEQ ID NO: 2805 - protein, 16 aa, Artificial
  Peptide with targeting and/or antimicrobial activity
  mod_res (2)..(5): Aib
  mod_res (8)..(9): Aib
  mod_res (10)..(10): Hydroxyproline
  mod_res (12)..(12): Aib
  mod_res (13)..(13): Aib
  mod_res (14)..(14): Aib
FXXXXGLXXXQXXXPF

SEQ ID NO: 2806 - protein, 17 aa, Artificial
  Peptide with targeting and/or antimicrobial activity
  mod_res (2)..(2): Isovaline
  mod_res (4)..(4): Aib
  mod_res (7)..(7): Aib
  mod_res (9)..(9): Aib
  mod_res (10)..(10): Hydroxyproline
  mod_res (12)..(12): Aib
  mod_res (13)..(13): Hydroxyproline
  mod_res (14)..(14): Aib
FXQXITXLXXQXXXPFS

SEQ ID NO: 2807 - protein, 17 aa, Artificial
  Peptide with targeting and/or antimicrobial activity
  mod_res (2)..(2): Isovaline
  mod_res (4)..(4): Aib
  mod_res (7)..(7): Aib
  mod_res (9)..(9): Aib
  mod_res (12)..(12): Aib
  mod_res (13)..(13): Hydroxyproline
  mod_res (14)..(14): Aib
FXQXITXLXPQXXXPFS

SEQ ID NO: 2808 - protein, 12 aa, Artificial
  Peptide with targeting and/or antimicrobial activity
  mod_res (2)..(2): Aib
  mod_res (4)..(4): Aib
  mod_res (6)..(6): Aib
  mod_res (9)..(9): Aib
LXPXLXPAXPVL

SEQ ID NO: 2809 - protein, 12 aa, Artificial
  Peptide with targeting and/or antimicrobial activity
  mod_res (2)..(2): Aib
  mod_res (4)..(4): Aib
  mod_res (6)..(6): Aib
  mod_res (9)..(9): Aib
LXPXLXPAXPVL

SEQ ID NO: 2810 - protein, 19 aa, Artificial
  Peptide with targeting and/or antimicrobial activity
  mod_res (2)..(2): Aib
  mod_res (4)..(5): Aib
  mod_res (9)..(10): Aib
  mod_res (13)..(13): Aib
  mod_res (15)..(17): Aib
FXSXXLQGXXAAXPXXXQW

SEQ ID NO: 2811 - protein, 19 aa, Artificial
  Peptide with targeting and/or antimicrobial activity
  mod_res (2)..(2): Aib
  mod_res (4)..(5): Aib
  mod_res (9)..(10): Aib
  mod_res (13)..(13): Aib
  mod_res (15)..(15): Isovaline
  mod_res (16)..(17): Aib
FXSXXLQGXXAAXPXXXQW

SEQ ID NO: 2812 - protein, 19 aa, Artificial
  Peptide with targeting and/or antimicrobial activity
  mod_res (2)..(2): Aib
  mod_res (4)..(4): Aib
  mod_res (5)..(5): Isovaline
  mod_res (9)..(10): Aib
  mod_res (13)..(13): Aib
  mod_res (15)..(17): Aib
FXSXXLQGXXAAXPXXXQW

SEQ ID NO: 2813 - protein, 19 aa, Artificial
  Peptide with targeting and/or antimicrobial activity
  mod_res (2)..(2): Aminoisobutyric acid
  mod_res (4)..(4): Aminoisobutyric acid
  mod_res (5)..(5): Isovaline
  mod_res (9)..(10): Aminoisobutyric acid
  mod_res (13)..(13): Aminoisobutyric acid
  mod_res (15)..(15): Isovaline
  mod_res (16)..(17): Aminoisobutyric acid
FXSXXLQGXXAABPXXXQW

SEQ ID NO: 2814 - protein, 14 aa, Artificial
  Peptide with targeting and/or antimicrobial activity
  mod_res (1)..(1): Aminoisobutyric acid
  mod_res (2)..(2): Hydroxyproline
  mod_res (4)..(4): Isovaline
  mod_res (5)..(5): Hydroxyproline
  mod_res (7)..(7): Isovaline
  mod_res (8)..(8): Hydroxyproline
  mod_res (9)..(9): Aminoisobutyric acid
  mod_res (10)..(10): Isovaline
  mod_res (11)..(11): Aminoisobutyric acid
  mod_res (12)..(12): Hydroxyproline
  mod_res (13)..(13): Isovaline
XXLXXLXXXXXXXI

SEQ ID NO: 2815 - protein, 16 aa, Artificial
  Peptide with targeting and/or antimicrobial activity
  mod_res (4)..(4): Aminoisobutyric acid
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIQXITXLXXQXXXPF

SEQ ID NO: 2816 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  mod_res (10)..(10): Hydroxyproline
  mod_res (11)..(11): Aminoisobutyric acid
  misc_feature (12)..(12): Xaa can be any naturally occurring amino acid
  mod_res (13)..(13): Aminoisobutyric acid
  mod_res (13)..(13): Hydroxyproline
  misc_feature (14)..(14): Xaa can be any naturally occurring amino acid
WIQXITXLXXQXXXPF

SEQ ID NO: 2817 - protein, 15 aa, Artificial
  Peptide with targeting and/or antimicrobial activity
  mod_res (2)..(4): Aminoisobutyric acid
  mod_res (8)..(9): Aminoisobutyric acid
  mod_res (10)..(10): Hydroxyproline
  mod_res (12)..(12): Isovaline
  mod_res (13)..(13): Hydroxyproline
  misc_feature (14)..(14): Xaa can be any naturally occurring amino acid
FXXXVGLXXXQXXXF

SEQ ID NO: 2818 - protein, 15 aa, Artificial
  Peptide with targeting and/or antimicrobial activity
  mod_res (2)..(4): Aminoisobutyric acid
  mod_res (8)..(9): Aminoisobutyric acid
  mod_res (10)..(10): Hydroxyproline
  mod_res (11)..(11): Isovaline
  misc_feature (12)..(12): Xaa can be any naturally occurring amino acid
  mod_res (13)..(13): Hydroxyproline
FXXXVGLXXXQXXAF

SEQ ID NO: 2819 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Isovaline
  mod_res (9)..(9): Aminoisobutyric acid
XNLIXPXLXPL

SEQ ID NO: 2820 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Aminoisobutyric acid
  mod_res (12)..(12): Aminoisobutyric acid
XNLXPSVXPXLXPL

SEQ ID NO: 2821 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XNLXPSVXPXLXPL

SEQ ID NO: 2822 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XNLXPAIXPXLXPL

SEQ ID NO: 2823 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Aminoisobutyric acid
  mod_res (12)..(12): Aminoisobutyric acid
XNLXPAVXPXLXPL

SEQ ID NO: 2824 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XNLXPAVXPXLXPL

SEQ ID NO: 2825 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XNLXPAVXPXLXPL

SEQ ID NO: 2826 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XQLXPAVXPXLXPL

SEQ ID NO: 2827 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Aminoisobutyric acid
  mod_res (12)..(12): Aminoisobutyric acid
XNLXPSIXPXLXPL

SEQ ID NO: 2828 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XNLXPSIXPXLXPL

SEQ ID NO: 2829 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XQLXPSIXPXLXPL

SEQ ID NO: 2830 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Aminoisobutyric acid
  mod_res (12)..(12): Aminoisobutyric acid
XNLXPAIXPXLXPL

SEQ ID NO: 2831 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Isovaline
  mod_res (12)..(12): Aminoisobutyric acid
XQLXPAIXPXLXPL

SEQ ID NO: 2832 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XNIIXPLLXPL

SEQ ID NO: 2833 - protein, 14 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
  mod_res (10)..(10): Aminoisobutyric acid
  mod_res (12)..(12): Aminoisobutyric acid
XNLXPSIXPXLXPV

SEQ ID NO: 2834 - protein, 12 aa, Artificial
  Peptide with targeting and/or antimicrobial activity
  mod_res (2)..(3): Ethylnorvaline
  mod_res (5)..(5): Aminoisobutyric acid
  mod_res (8)..(9): Aminoisobutyric acid
PXXAXIIXXAAE

SEQ ID NO: 2835 - protein, 13 aa, Artificial
  Peptide with targeting and/or antimicrobial activity
  mod_res (2)..(3): Ethylnorvaline
  mod_res (5)..(5): Aminoisobutyric acid
  mod_res (8)..(9): Aminoisobutyric acid
PXXAXIIXXAMAE

SEQ ID NO: 2836 - protein, 15 aa, Artificial
  Peptide with targeting and/or antimicrobial activity
  mod_res (2)..(4): Aminoisobutyric acid
  mod_res (8)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
FXXXVGLXXXQXXXF

SEQ ID NO: 2837 - protein, 20 aa, Artificial
  Peptide with targeting and/or antimicrobial activity
  mod_res (1)..(1): Aminoisobutyric acid
  mod_res (3)..(3): Aminoisobutyric acid
  misc_feature (5)..(5): Xaa can be any naturally occurring amino acid
  mod_res (6)..(7): Aminoisobutyric acid
  mod_res (9)..(9): Aminoisobutyric acid
  mod_res (11)..(13): Aminoisobutyric acid
  mod_res (16)..(17): Aminoisobutyric acid
XPXAXXQLXGXXXPVXXQQL

SEQ ID NO: 2838 - protein, 20 aa, Artificial
  Peptide with targeting and/or antimicrobial activity
  mod_res (1)..(1)
  mod_res (3)..(3)
  mod_res (5)..(6)
  mod_res (8)..(8)
  mod_res (10)..(10)
  mod_res (12)..(13)
  mod_res (16)..(17)
XPXAXXQXLXGXXPVXXQQL

SEQ ID NO: 2839 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXLXGXXPVXXQQL

SEQ ID NO: 2840 - protein, 19 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXQQ

SEQ ID NO: 2841 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXIXGXXPVXXQQL

SEQ ID NO: 2842 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (4)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XPXAXXQXLXGXXPVXXQQL

SEQ ID NO: 2843 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XPXAXXQXIXGXXPVXXQQL

SEQ ID NO: 2844 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXQQI

SEQ ID NO: 2845 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXLXGXXPVXXQQI

SEQ ID NO: 2846 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XPXAXAQXLXGXXPVXXQQL

SEQ ID NO: 2847 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXIXGXXPVXXQQL

SEQ ID NO: 2848 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
BPBABBQBLBGBBPVBBEQL

SEQ ID NO: 2849 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
BPBABAQBLBGBBPVBBEQL

SEQ ID NO: 2850 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XPXAXXQXLXGXXPVXXEQL

SEQ ID NO: 2851 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXIXGXXPVXXEQL

SEQ ID NO: 2852 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXEQI

SEQ ID NO: 2853 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XQVVXPLLXPL

SEQ ID NO: 2854 - protein, 11 aa, Artificial
  Peptide with targeting and/or antimicrobial activity
  mod_res (1)..(1): Isovaline
  mod_res (5)..(5): Aminoisobutyric acid
  mod_res (9)..(9): Aminoisobutyric acid
XQVVXPLLXPL

SEQ ID NO: 2855 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XQVLXPLIXPL

SEQ ID NO: 2856 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XQIVXPLLXPL

SEQ ID NO: 2857 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XQIIXPLLXPL

SEQ ID NO: 2858 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XQILXPLIXPL

SEQ ID NO: 2859 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Aminoisobutyric acid
  mod_res (9)..(9): Aminoisobutyric acid
  mod_res (11)..(12): Aminoisobutyric acid
  mod_res (15)..(16): Aminoisobutyric acid
XSALXQXVXGXXPLXXQV

SEQ ID NO: 2860 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Aminoisobutyric acid
  mod_res (9)..(9): Aminoisobutyric acid
  mod_res (11)..(12): Aminoisobutyric acid
  mod_res (15)..(16): Aminoisobutyric acid
XSALXQXVXGXXPLXXQL

SEQ ID NO: 2861 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Aminoisobutyric acid
  mod_res (9)..(9): Aminoisobutyric acid
  mod_res (11)..(12): Aminoisobutyric acid
  mod_res (15)..(16): Aminoisobutyric acid
XAALXQXVXGXXPLXXQV

SEQ ID NO: 2862 - protein, 18 aa, Artificial
  Peptide with targeting and/or antimicrobial activity
  mod_res (1)..(1): Aminoisobutyric Acid
  mod_res (5)..(5): Aminoisobutyric Acid
  misc_feature (7)..(7): Xaa can be any naturally occurring amino acid
  mod_res (9)..(9): Aminoisobutyric Acid
  mod_res (11)..(12): Aminoisobutyric Acid
  mod_res (15)..(16): Aminoisobutyric Acid
BSALBQXVBGBBPLBBQV

SEQ ID NO: 2863 - protein, 18 aa, Artificial
  Peptide with targeting and/or antimicrobial activity
  mod_res (1)..(1): Aminoisobutyric Acid
  mod_res (5)..(5): Aminoisobutyric Acid
  mod_res (7)..(7): Aminoisobutyric Acid
  mod_res (9)..(9): Aminoisobutyric Acid
  mod_res (11)..(11): Isovaline
  mod_res (12)..(12): Aminoisobutyric Acid
  mod_res (15)..(16): Aminoisobutyric Acid
XSALXQXVXGXXPLXXQV

SEQ ID NO: 2864 - protein, 18 aa, Artificial
  Peptide with targeting and/or antimicrobial activity
  mod_res (1)..(1): Aminoisobutyric Acid
  mod_res (5)..(5): Aminoisobutyric Acid
  mod_res (7)..(7): Aminoisobutyric Acid
  mod_res (9)..(9): Aminoisobutyric Acid
  mod_res (9)..(9): Aminoisobutyric acid
  mod_res (11)..(11): Isovaline
  mod_res (12)..(12): Aminoisobutyric Acid
  mod_res (15)..(16): Aminoisobutyric Acid
XSALXQXVXGXXPLXXQL

SEQ ID NO: 2865 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  misc_feature (10)..(10): Xaa can be any naturally occurring amino acid
  mod_res (12)..(12): Aminoisobutyric acid
  misc_feature (13)..(13): Xaa can be any naturally occurring amino acid
  mod_res (14)..(14): Aminoisobutyric acid
LIQXITXLXXQXXXPF

SEQ ID NO: 2866 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
BABABAQBVBGLBPVBBQQF

SEQ ID NO: 2867 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAXAXAQXVXGLXPVXXQQF

SEQ ID NO: 2868 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAXAXXQXVXGLXPVXXQQF

SEQ ID NO: 2869 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAXAXXQXVXGLXPVXXQQF

SEQ ID NO: 2870 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
BABABAQBVBGLBPVBBEQF

SEQ ID NO: 2871 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAXAXAQXVXGLXPVXXEQF

SEQ ID NO: 2872 - protein, 11 aa, Artificial
  Peptide with targeting and/or antimicrobial activity
  mod_res (1)..(1): Aminoisobutyric acid
  mod_res (4)..(4): Aminoisobutyric acid
  mod_res (7)..(7): Aminoisobutyric acid
  mod_res (8)..(8): Ethylnorvaline or Q
XPYXQQXXQAL

SEQ ID NO: 2873 - protein, 11 aa, Artificial
  Peptide with targeting and/or antimicrobial activity
  mod_res (1)..(1): Aminoisobutyric acid
  mod_res (4)..(4): Aminoisobutyric acid
  mod_res (7)..(8): Aminoisobutyric acid
XPFXQQXXQAL

SEQ ID NO: 2874 - protein, 10 aa, Artificial
  Peptide with targeting and/or antimicrobial activity
  mod_res (1)..(1): Aminoisobutyric acid
  mod_res (4)..(4): Aminoisobutyric acid
  mod_res (7)..(7): Aminoisobutyric acid
  mod_res (8)..(8): Ethylnorvaline or Q
SPFSQQXXAL

SEQ ID NO: 2875 - protein, 12 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(9): Aminoisobutyric acid
  mod_res (12)..(12): Aminoisobutyric acid
XAAXXQXXXSLX

SEQ ID NO: 2876 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXAQXVXGXXPVXXQQF

SEQ ID NO: 2877 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXAQXLXGXXPVXXQQF

SEQ ID NO: 2878 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXXQXVXGXXPVXXQQF

SEQ ID NO: 2879 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXXQXLXGXXPVXXQQF

SEQ ID NO: 2880 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(12): Aminoisobutyric acid
  mod_res (16)..(17): Aminoisobutyric acid
XAXAXAQXLXGXAPVXXQQF

SEQ ID NO: 2881 - protein, 5 aa, Artificial
  Peptide with targeting and/or antimicrobial activity
  mod_res (2)..(2): Aminoisobutyric acid
  mod_res (4)..(4): Aminoisobutyric acid
LXLXF

SEQ ID NO: 2882 - protein, 19 aa, Artificial
  Peptide with targeting and/or antimicrobial activity
  mod_res (2)..(2): Aminoisobutyric acid
  mod_res (4)..(4): Aminoisobutyric acid
  mod_res (5)..(5): Isovaline
  mod_res (9)..(10): Aminoisobutyric acid
  mod_res (13)..(13): Aminoisobutyric acid
  mod_res (14)..(14): Isovaline
  misc_feature (15)..(15): Xaa can be any naturally occurring amino acid
  mod_res (16)..(17): Aminoisobutyric acid
FXAXXLQGXXAAXPXXXQW

SEQ ID NO: 2883 - protein, 19 aa, Artificial
  Peptide with targeting and/or antimicrobial activity
  mod_res (2)..(2): Aminoisobutyric acid
  mod_res (4)..(4): Aminoisobutyric acid
  mod_res (5)..(5): Isovaline
  mod_res (8)..(9): Aminoisobutyric acid
  misc_feature (10)..(10): Xaa can be any naturally occurring amino acid
  mod_res (13)..(13): Aminoisobutyric acid
  mod_res (15)..(15): Isovaline
  mod_res (16)..(17): Isovaline
FXSXXLQGXXAAXPXXXQF

SEQ ID NO: 2884 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XPXAXXQXVXGVXPVXXQQF

SEQ ID NO: 2885 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XPXAXXQXVXGLXPVXXQQF

SEQ ID NO: 2886 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XPXAXXQXIXGLXPVXXQQF

SEQ ID NO: 2887 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
XPXAXXQXIXGLXPVXVQQF

SEQ ID NO: 2888 - protein, 10 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XNIIXPLLXP

SEQ ID NO: 2889 - protein, 8 aa, Artificial
  Peptide with targeting and/or antimicrobial activity
  mod_res (1)..(1): Aminoisobutyric acid
  mod_res (5)..(5): Aminoisobutyric acid
XNIIXPLV

SEQ ID NO: 2890 - protein, 15 aa, Artificial
  Peptide with targeting and/or antimicrobial activity
  mod_res (2)..(4): Aminoisobutyric acid
  mod_res (8)..(9): Aminoisobutyric acid
  mod_res (10)..(10): Hydroxyproline
  mod_res (12)..(12): Isovaline
  mod_res (13)..(13): Hydroxyproline
FXXXVGLXXXQXXAF

SEQ ID NO: 2891 - protein, 15 aa, Artificial
  Peptide with targeting and/or antimicrobial activity
  mod_res (2)..(4): Aminoisobutyric acid
  mod_res (8)..(9): Aminoisobutyric acid
  mod_res (10)..(10): Hydroxyproline
  mod_res (12)..(12): Isovaline
  mod_res (13)..(13): Hydroxyproline
  misc_feature (14)..(14): Xaa can be any naturally occurring amino acid
FXXXVGLXXXQXXXF

SEQ ID NO: 2892 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXAQXLXGXXPVXXQQF

SEQ ID NO: 2893 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Hydroxyproline
XAXAXAQXLXGXXPVXXQQF

SEQ ID NO: 2894 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXXQXLXGXXPVXXQQF

SEQ ID NO: 2895 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XAXAXXQXLXGXXPVXXQQF

SEQ ID NO: 2896 - protein, 15 aa, Artificial
  Peptide with targeting and/or antimicrobial activity
  mod_res (2)..(4): Aminoisobutyric acid
  mod_res (8)..(9): Aminoisobutyric acid
  mod_res (10)..(10): Hydroxyproline
  mod_res (12)..(12): Isovaline
  mod_res (13)..(13): Hydroxyproline
FXXXVGLXXXQXXAF

SEQ ID NO: 2897 - protein, 15 aa, Artificial
  Peptide with targeting and/or antimicrobial activity
  mod_res (2)..(4): Aminoisobutyric acid
  mod_res (8)..(9): Aminoisobutyric acid
  mod_res (10)..(10): Hydroxyproline
  mod_res (12)..(12): Isovaline
  mod_res (13)..(13): Hydroxyproline
  misc_feature (14)..(14): Xaa can be any naturally occurring amino acid
FXXXVGLXXXQXXXF

SEQ ID NO: 2898 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXVXGXXPVXXEQV

SEQ ID NO: 2899 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXLXGXXPVXXEQV

SEQ ID NO: 2900 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(12): Aminoisobutyric acid
  mod_res (16)..(17): Aminoisobutyric acid
XPXAXXQXVXGXAPVXXEQL

SEQ ID NO: 2901 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXLXGXXPVXXEQL

SEQ ID NO: 2902 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXEQV

SEQ ID NO: 2903 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
  mod_res (20)..(20): Isovaline
XPXAXAQXLXGXXPVXXEQX

SEQ ID NO: 2904 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXEQI

SEQ ID NO: 2905 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXVXGXXPVXXQQV

SEQ ID NO: 2906 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXLXGXXPVXXQQV

SEQ ID NO: 2907 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXVXGXXPVXXQQL

SEQ ID NO: 2908 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXAQXLXGXXPVXXQQL

SEQ ID NO: 2909 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXQQV

SEQ ID NO: 2910 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXVXGXXPVXXQQV

SEQ ID NO: 2911 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXQQL

SEQ ID NO: 2912 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXVXGXXPVXXQQL

SEQ ID NO: 2913 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXLXGXXPVXXQQI

SEQ ID NO: 2914 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XPXAXXQXVXGXXPVXXQQI

SEQ ID NO: 2915 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  misc_feature (9)..(10): Xaa can be any naturally occurring amino acid
  mod_res (13)..(13): Aminoisobutyric acid
  mod_res (16)..(17): Aminoisobutyric acid
XAXAXAQXXXGLXPVXXQQF

SEQ ID NO: 2916 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (8)..(9): Aminoisobutyric acid
XNLLXPLXXPL

SEQ ID NO: 2917 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XNLLXPVLXPV

SEQ ID NO: 2918 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XNVLXPLLXPV

SEQ ID NO: 2919 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XNLVXPLLXPV

SEQ ID NO: 2920 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (8)..(8): Aminoisobutyric acid
XNLLXPVXVPL

SEQ ID NO: 2921 - protein, 11 aa, Artificial
  Peptide with targeting and/or antimicrobial activity
BNVLBPLBVPL

SEQ ID NO: 2922 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (8)..(8): Aminoisobutyric acid
XNLVXPLXVPL

SEQ ID NO: 2923 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (8)..(8): Aminoisobutyric acid
XNLLXPLXVPV

SEQ ID NO: 2924 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXAQXLXGXXPVXXQQF

SEQ ID NO: 2925 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XAXAXAQXLXGXXPVXXQQF

SEQ ID NO: 2926 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(17): Aminoisobutyric acid
XAXAXAQXIXGXXPVXXQQF

SEQ ID NO: 2927 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XAXAXAQXIXGXXPVXXQQF

SEQ ID NO: 2928 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAXAXAQXLXGLXPVXXQQF

SEQ ID NO: 2929 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAXAXAQXLXGLXPVXXQQF

SEQ ID NO: 2930 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAXAXAQXIXGLXPVXXQQF

SEQ ID NO: 2931 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAXAXAQXIXGLXPVXXQQF

SEQ ID NO: 2932 - protein, 20 aa, Artificial
  Peptide with targeting and/or antimicrobial activity
BABABAQBLBGBBPVBBEQF

SEQ ID NO: 2933 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (12)..(13): Aminoisobutyric acid
  mod_res (16)..(16): Aminoisobutyric acid
  mod_res (17)..(17): Isovaline
XAXAXAQXLXGXXPVXXEQF

SEQ ID NO: 2934 - protein, 7 aa, Artificial
  Peptide with targeting and/or antimicrobial activity
  mod_res (4)..(4): Aminoisobutyric acid
GGLXGIL

SEQ ID NO: 2935 - protein, 7 aa, Artificial
  Peptide with targeting and/or antimicrobial activity
  mod_res (4)..(4): Aminoisobutyric acid
GGLXGLL

SEQ ID NO: 2936 - protein, 11 aa, Artificial
  Peptide with targeting and/or antimicrobial activity
  mod_res (1)..(1): Aminoisobutyric acid
  mod_res (4)..(4): Aminoisobutyric acid
  mod_res (8)..(8): Aminoisobutyric acid
XGLXGGLXGIL

SEQ ID NO: 2937 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Isovaline
  mod_res (9)..(9): Aminoisobutyric acid
  mod_res (11)..(12): Aminoisobutyric acid
  mod_res (15)..(16): Aminoisobutyric acid
XSAXXQXLXAXXPLXXQI

SEQ ID NO: 2938 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Aminoisobutyric acid
  mod_res (9)..(9): Aminoisobutyric acid
  mod_res (11)..(12): Aminoisobutyric acid
  mod_res (15)..(16): Aminoisobutyric acid
XSAXXQXLXAXXPLXXQI

SEQ ID NO: 2939 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Aminoisobutyric acid
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XSAXXQXLXAXXPLXXQI

SEQ ID NO: 2940 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Isovaline
  mod_res (9)..(9): Aminoisobutyric acid
  mod_res (11)..(12): Aminoisobutyric acid
  mod_res (15)..(16): Aminoisobutyric acid
XSAXXQXLXAXXPLXXQL

SEQ ID NO: 2941 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Isovaline
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XSAXXQXLXAXXPLXXQL

SEQ ID NO: 2942 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Aminoisobutyric acid
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XSAXXQXLXAXXPLXXQL

SEQ ID NO: 2943 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Isovaline
  mod_res (9)..(9): Aminoisobutyric acid
  mod_res (11)..(12): Aminoisobutyric acid
  mod_res (15)..(16): Aminoisobutyric acid
XSAXXQXLXAXXPLXXQI

SEQ ID NO: 2944 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Isovaline
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XSAXXQXLXAXXPLXXQI

SEQ ID NO: 2945 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Aminoisobutyric acid
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XSAXXQXLXAXXPLXXQI

SEQ ID NO: 2946 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Isovaline
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XSAXXQXLXAXXPLXXQL

SEQ ID NO: 2947 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Isovaline
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XSAXXQXLXAXXPLXXQI

SEQ ID NO: 2948 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (16)..(17): Aminoisobutyric acid
XAXAXAQXVXGLAPVXXQQF

SEQ ID NO: 2949 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XGXAXAQXVXGLXPVXXQQF

SEQ ID NO: 2950 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAXAXAQXVXGLXPAXXQQF

SEQ ID NO: 2951 - protein, 20 aa, Artificial
  Peptide with targeting and/or antimicrobial activity
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
AAXAXAQXVXGLXPVXXQQF

SEQ ID NO: 2952 - protein, 20 aa, Artificial
  Peptide with targeting and/or antimicrobial activity
  mod_res (1)..(1): Aminoisobutyric acid
  mod_res (5)..(5): Aminoisobutyric acid
  misc_feature (8)..(8): Xaa can be any naturally occurring amino acid
  mod_res (10)..(10): Aminoisobutyric acid
  mod_res (13)..(13): Aminoisobutyric acid
  mod_res (16)..(17): Aminoisobutyric acid
XAAAXAQXVXGLXPVXXQQF

SEQ ID NO: 2953 - protein, 19 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(7): Aminoisobutyric acid
  mod_res (9)..(9): Aminoisobutyric acid
  mod_res (11)..(11): Aminoisobutyric acid
  misc_feature (12)..(12): Xaa can be any naturally occurring amino acid
  mod_res (15)..(16): Aminoisobutyric acid
XAXAXQXVXGLXPVXXQQF

SEQ ID NO: 2954 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAXAXAQXVXGLXPVXXQQF

SEQ ID NO: 2955 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAXAXXQXVXGLXPVXXQQF

SEQ ID NO: 2956 - protein, 20 aa, Artificial
  Peptide with targeting and/or antimicrobial activity
  mod_res (1)..(1): Aminoisobutyric acid
  mod_res (3)..(3): Aminoisobutyric acid
  misc_feature (5)..(5): Xaa can be any naturally occurring amino acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAXAXAQXVXGLXPVXXQQF

SEQ ID NO: 2957 - protein, 19 aa, Artificial
  Peptide with targeting and/or antimicrobial activity
  mod_res (1)..(1): Aminoisobutyric acid
  mod_res (4)..(5): Aminoisobutyric acid
  mod_res (7)..(9): Aminoisobutyric acid
  mod_res (12)..(12): Aminoisobutyric acid
  mod_res (15)..(16): Aminoisobutyric acid
XGFXXQXXXSLXPVXXQQL

SEQ ID NO: 2958 - protein, 19 aa, Artificial
  Peptide with targeting and/or antimicrobial activity
  mod_res (1)..(1): Aminoisobutyric acid
  mod_res (4)..(5): Aminoisobutyric acid
  mod_res (7)..(9): Aminoisobutyric acid
  mod_res (12)..(12): Aminoisobutyric acid
  mod_res (15)..(15): Aminoisobutyric acid
  mod_res (16)..(16): Isovaline
XGFXXQXXXSLXPVXXQQL

SEQ ID NO: 2959 - protein, 14 aa, Artificial
  Peptide with targeting and/or antimicrobial activity
  mod_res (2)..(3): Ethylnorvaline
  mod_res (5)..(6): Aminoisobutyric acid
  mod_res (9)..(10): Aminoisobutyric acid
PXXAXXIAXXAMAE

SEQ ID NO: 2960 - protein, 14 aa, Artificial
  Peptide with targeting and/or antimicrobial activity
  mod_res (2)..(3): Ethylnorvaline
  mod_res (5)..(6): Aminoisobutyric acid
  mod_res (9)..(10): Aminoisobutyric acid
PXXAXXVAXXAMAE

SEQ ID NO: 2961 - protein, 14 aa, Artificial
  Peptide with targeting and/or antimicrobial activity
  mod_res (2)..(3): Ethylnorvaline
  mod_res (5)..(6): Aminoisobutyric acid
  mod_res (9)..(9): Aminoisobutyric acid
PXXAXXIAXAAMAE

SEQ ID NO: 2962 - protein, 14 aa, Artificial
  Peptide with targeting and/or antimicrobial activity
  mod_res (2)..(3): Ethylnorvaline
  mod_res (5)..(6): Aminoisobutyric acid
  mod_res (9)..(9): Aminoisobutyric acid
PXXAXXVAXAAMAE

SEQ ID NO: 2963 - protein, 14 aa, Artificial
  Peptide with targeting and/or antimicrobial activity
  mod_res (2)..(3): Ethylnorvaline
  mod_res (5)..(6): Aminoisobutyric acid
  misc_feature (8)..(8): Xaa can be any naturally occurring amino acid
  mod_res (9)..(10): Aminoisobutyric acid
PXXAXXIXXBAMAE

SEQ ID NO: 2964 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
XNVXXPXXXPV

SEQ ID NO: 2965 - protein, 11 aa, Artificial
  Peptide with targeting and/or antimicrobial activity
  mod_res (1)..(1): Aminoisobutyric acid
  mod_res (4)..(4): Aminoisobutyric acid
  misc_feature (5)..(5): Xaa can be any naturally occurring amino acid
  mod_res (7)..(8): L or I
  mod_res (9)..(9): Aminoisobutyric acid
  mod_res (11)..(11): L or I
XNVVXPXXXPX

SEQ ID NO: 2966 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (7)..(8): L or I
  mod_res (9)..(9): Aminoisobutyric acid
  mod_res (11)..(11): L or I
XNVVXPXXXPX

SEQ ID NO: 2967 - protein, 11 aa, Artificial
  Peptide with targeting and/or antimicrobial activity
  mod_res (1)..(1): Aminoisobutyric acid
  mod_res (3)..(3): L or I
  mod_res (5)..(5): Aminoisobutyric acid
  mod_res (7)..(8): L or I
  mod_res (9)..(9): Aminoisobutyric acid
XNXVXPXXBPV

SEQ ID NO: 2968 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (7)..(8): L or I
  mod_res (9)..(9): Aminoisobutyric acid
  mod_res (11)..(11): L or I
XQVVXPXXXPX

SEQ ID NO: 2969 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
XQVXXPXXXPV

SEQ ID NO: 2970 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (7)..(8): L or I
  mod_res (9)..(9): Aminoisobutyric acid
  mod_res (11)..(11): L or I
XQVVXPXXXPX

SEQ ID NO: 2971 - protein, 11 aa, Artificial
  Peptide with targeting and/or antimicrobial activity
  mod_res (1)..(1): Aminoisobutyric acid
  mod_res (3)..(3): L or I
  mod_res (5)..(5): Aminoisobutyric acid
  mod_res (7)..(8): L or I
  mod_res (9)..(9): Aminoisobutyric acid
XQXVXPXXXPV

SEQ ID NO: 2972 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
  misc_feature (11)..(11): Xaa can be any naturally occurring amino acid
XNVXXPXXXPX

SEQ ID NO: 2973 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
  mod_res (11)..(11): L or I
XQVXXPXXXPX

SEQ ID NO: 2974 - protein, 11 aa, Artificial
  Peptide with targeting and/or antimicrobial activity
  mod_res (1)..(1): Aminoisobutyric acid
  mod_res (3)..(4): L or I
  mod_res (5)..(5): Aminoisobutyric acid
  mod_res (7)..(8): L or I
  mod_res (9)..(9): Aminoisobutyric acid
XQXXXPXXXPV

SEQ ID NO: 2975 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
  mod_res (11)..(11): L or I
XNVXXPXXXPX

SEQ ID NO: 2976 - protein, 11 aa, Artificial
  Peptide with targeting and/or antimicrobial activity
  mod_res (1)..(1): Aminoisobutyric acid
  mod_res (3)..(4): L or I
  mod_res (5)..(5): Aminoisobutyric acid
  mod_res (7)..(8): L or I
  mod_res (9)..(9): Aminoisobutyric acid
XNXXXPXXXPV

SEQ ID NO: 2977 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
  mod_res (11)..(11): L or I
XNVXXPXXXPX

SEQ ID NO: 2978 - protein, 11 aa, Artificial
  Peptide with targeting and/or antimicrobial activity
  misc_feature (3)..(4): Xaa can be any naturally occurring amino acid
  misc_feature (7)..(8): Xaa can be any naturally occurring amino acid
BNXXBPXXBPV

SEQ ID NO: 2979 - protein, 11 aa, Artificial
  Peptide with targeting and/or antimicrobial activity
  mod_res (1)..(1): Aminoisobutyric acid
  mod_res (3)..(3): L or I
  mod_res (5)..(5): Aminoisobutyric acid
  mod_res (7)..(8): L or I
  mod_res (9)..(9): Aminoisobutyric acid
  mod_res (11)..(11): L o rI
XNXVXPXXXPX

SEQ ID NO: 2980 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
XQVXXPXXXPV

SEQ ID NO: 2981 - protein, 11 aa, Artificial
  Peptide with targeting and/or antimicrobial activity
  mod_res (1)..(1): Aminoisobutyric acid
  mod_res (4)..(4): L or I
  mod_res (5)..(5): Aminoisobutyric acid
  mod_res (7)..(8): L or I
  mod_res (9)..(9): Aminoisobutyric acid
  mod_res (11)..(11): L or I
XQVXXPXXXPX

SEQ ID NO: 2982 - protein, 11 aa, Artificial
  Peptide with targeting and/or antimicrobial activity
  mod_res (1)..(1): Aminoisobutyric acid
  mod_res (3)..(3): L or I
  mod_res (5)..(5): Aminoisobutyric acid
  mod_res (7)..(8): L or I
  mod_res (9)..(9): Aminoisobutyric acid
  mod_res (11)..(11): L or I
XQXVXPXXXPX

SEQ ID NO: 2983 - protein, 11 aa, Artificial
  Peptide with targeting and/or antimicrobial activity
  mod_res (1)..(1): Aminoisobutyric acid
  mod_res (3)..(4): L or I
  mod_res (5)..(5): Aminoisobutyric acid
  mod_res (7)..(8): L or I
  mod_res (9)..(9): Aminoisobutyric acid
  mod_res (11)..(11): L or I
XNXXXPXXXPX

SEQ ID NO: 2984 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XNIIXPLLXPI

SEQ ID NO: 2985 - protein, 11 aa, Artificial
  Peptide with targeting and/or antimicrobial activity
  mod_res (1)..(1): Aminoisobutyric acid
  mod_res (3)..(4): L or I
  mod_res (5)..(5): Aminoisobutyric acid
  mod_res (7)..(8): L or I
  mod_res (9)..(9): Aminoisobutyric acid
XNXXXPXXXPL

SEQ ID NO: 2986 - protein, 11 aa, Artificial
  Peptide with targeting and/or antimicrobial activity
  mod_res (1)..(1): Aminoisobutyric acid
  mod_res (3)..(4): L or I
  mod_res (5)..(5): Aminoisobutyric acid
  mod_res (7)..(8): L or I
  mod_res (9)..(9): Aminoisobutyric acid
  mod_res (11)..(11): L or I
XQXXXPXXXPX

SEQ ID NO: 2987 - protein, 11 aa, Artificial
  Peptide with targeting and/or antimicrobial activity
  mod_res (1)..(1): Aminoisobutyric acid
  mod_res (3)..(4): L or I
  mod_res (5)..(5): Aminoisobutyric acid
  mod_res (7)..(8): L or I
  mod_res (9)..(9): Aminoisobutyric acid
  mod_res (11)..(11): L or I
XQXXXPXXXPX

SEQ ID NO: 2988 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XNILXPILXPV

SEQ ID NO: 2989 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XQILXPILXPV

SEQ ID NO: 2990 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
CNILCPILCPL

SEQ ID NO: 2991 - protein, 11 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
XQILXPILXPL

SEQ ID NO: 2992 - protein, 19 aa, Artificial
  Peptide with targeting and/or antimicrobial activity
  mod_res (1)..(1): Aminoisobutyric acid
  mod_res (4)..(5): Aminoisobutyric acid
  mod_res (7)..(9): Aminoisobutyric acid
  mod_res (11)..(11): Aminoisobutyric acid
  misc_feature (12)..(12): Xaa can be any naturally occurring amino acid
  mod_res (14)..(14): Aminoisobutyric acid
  misc_feature (15)..(15): Xaa can be any naturally occurring amino acid
XAAXXQXXXSLXPVXIQQW

SEQ ID NO: 2993 - protein, 19 aa, Artificial
  Peptide with targeting and/or antimicrobial activity
  mod_res (1)..(1): Aminoisobutyric acid
  mod_res (4)..(5): Aminoisobutyric acid
  mod_res (7)..(9): Aminoisobutyric acid
  mod_res (12)..(12): Aminoisobutyric acid
  mod_res (15)..(15): Aminoisobutyric acid
XAAXXQXXXSLXPLXIQEW

SEQ ID NO: 2994 - protein, 19 aa, Artificial
  Peptide with targeting and/or antimicrobial activity
  mod_res (1)..(1): Aminoisobutyric acid
  mod_res (4)..(5): Aminoisobutyric acid
  mod_res (7)..(9): Aminoisobutyric acid
  mod_res (12)..(12): Aminoisobutyric acid
  mod_res (15)..(15): Aminoisobutyric acid
XAAXXQXXXSLXPVXIQEW

SEQ ID NO: 2995 - protein, 19 aa, Artificial
  Peptide with targeting and/or antimicrobial activity
  mod_res (1)..(1): Aminoisobutyric acid
  mod_res (4)..(4): Aminoisobutyric acid
  misc_feature (5)..(5): Xaa can be any naturally occurring amino acid
  mod_res (7)..(9): Aminoisobutyric acid
  mod_res (12)..(12): Aminoisobutyric acid
  mod_res (15)..(15): Aminoisobutyric acid
XAAXXQXXXSLXPVXIQEW

SEQ ID NO: 2996 - protein, 19 aa, Artificial
  Peptide with targeting and/or antimicrobial activity
  mod_res (1)..(1): Aminoisobutyric acid
  mod_res (4)..(5): Aminoisobutyric acid
  mod_res (7)..(9): Aminoisobutyric acid
  mod_res (12)..(12): Aminoisobutyric acid
  mod_res (15)..(15): Aminoisobutyric acid
XAAXXQXXXSLXPLXIQEF

SEQ ID NO: 2997 - protein, 19 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(9): Aminoisobutyric acid
  mod_res (12)..(12): Aminoisobutyric acid
  mod_res (15)..(15): Aminoisobutyric acid
XAAXXQXXXSLXPLXIQEF

SEQ ID NO: 2998 - protein, 19 aa, Artificial
  Peptide with targeting and/or antimicrobial activity
  mod_res (1)..(1): Aminoisobutyric acid
  mod_res (4)..(5): Aminoisobutyric acid
  mod_res (7)..(9): Aminoisobutyric acid
  mod_res (12)..(12): Aminoisobutyric acid
  mod_res (15)..(15): Aminoisobutyric acid
XAAXXQXXXSLXPVXIQEF

SEQ ID NO: 2999 - protein, 19 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(9): Aminoisobutyric acid
  mod_res (12)..(12): Aminoisobutyric acid
  mod_res (15)..(15): Aminoisobutyric acid
XAAXXQXXXSLXPVXIQEF

SEQ ID NO: 3000 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XGAXXQXVXGLXPLXXQL

SEQ ID NO: 3001 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Aminoisobutyric acid
  mod_res (9)..(9): Aminoisobutyric acid
  mod_res (12)..(12): Aminoisobutyric acid
  mod_res (15)..(15): Aminoisobutyric acid
  misc_feature (16)..(16): Xaa can be any naturally occurring amino acid
XGAXXQXVXGLXPLXXQL

SEQ ID NO: 3002 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XGAXXQXVXGLXPLXXQL

SEQ ID NO: 3003 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(15): Aminoisobutyric acid
  misc_feature (16)..(16): Xaa can be any naturally occurring amino acid
XGAXXQXVXGLXPLXXQL

SEQ ID NO: 3004 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  misc_feature (7)..(7): Xaa can be any naturally occurring amino acid
  mod_res (8)..(8): Isovaline
  mod_res (9)..(9): Aminoisobutyric acid
  mod_res (12)..(12): Aminoisobutyric acid
  mod_res (15)..(15): Aminoisobutyric acid
  misc_feature (16)..(16): Xaa can be any naturally occurring amino acid
XGAXXQXVXGLXPLXXQL

SEQ ID NO: 3005 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (9)..(9): Aminoisobutyric acid
  misc_feature (12)..(12): Xaa can be any naturally occurring amino acid
  mod_res (15)..(15): Aminoisobutyric acid
  mod_res (16)..(16): Isovaline
XGAXXQVVXGLXPLXXQL

SEQ ID NO: 3006 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXLXGLXPLXXQV

SEQ ID NO: 3007 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXLXGLXPLXXQV

SEQ ID NO: 3008 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Isovaline
  mod_res (9)..(9): Aminoisobutyric acid
  mod_res (12)..(12): Aminoisobutyric acid
  mod_res (15)..(16): Aminoisobutyric acid
XSAXXQXLXGLXPLXXQV

SEQ ID NO: 3009 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQW

SEQ ID NO: 3010 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Isovaline
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQW

SEQ ID NO: 3011 - protein, 18 aa, Artificial
  Peptide with targeting and/or antimicrobial activity
  mod_res (1)..(1): Aminoisobutyric acid
  mod_res (4)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQW

SEQ ID NO: 3012 - protein, 18 aa, Artificial
  Peptide with targeting and/or antimicrobial activity
  mod_res (1)..(1): Aminoisobutyric acid
  misc_feature (4)..(4): Xaa can be any naturally occurring amino acid
  mod_res (5)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQF

SEQ ID NO: 3013 - protein, 18 aa, Artificial
  Peptide with targeting and/or antimicrobial activity
  mod_res (1)..(1): Aminoisobutyric acid
  mod_res (4)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQW

SEQ ID NO: 3014 - protein, 18 aa, Artificial
  Peptide with targeting and/or antimicrobial activity
  mod_res (1)..(1): Aminoisobutyric acid
  mod_res (4)..(4): Aminoisobutyric acid
  mod_res (5)..(5): Isovaline
  mod_res (7)..(7): Isovaline
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQF

SEQ ID NO: 3015 - protein, 18 aa, Artificial
  Peptide with targeting and/or antimicrobial activity
  mod_res (1)..(1): Aminoisobutyric acid
  mod_res (4)..(5): Isovaline
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQF

SEQ ID NO: 3016 - protein, 18 aa, Artificial
  Peptide with targeting and/or antimicrobial activity
  mod_res (1)..(1): Aminoisobutyric acid
  mod_res (4)..(5): Aminoisobutyric acid
  mod_res (7)..(7): Aminoisobutyric acid
  mod_res (9)..(9): Aminoisobutyric acid
  mod_res (12)..(12): Aminoisobutyric acid
  mod_res (15)..(16): Aminoisobutyric acid
XSAXXQXVXGLXPLXXQW

SEQ ID NO: 3017 - protein, 23 aa, Artificial
  Peptide with targeting and/or antimicrobial activity
  mod_res (1)..(1): Aminoisobutyric acid
  mod_res (4)..(4): Aminoisobutyric acid
  mod_res (6)..(6): Aminoisobutyric acid
  mod_res (8)..(8): Aminoisobutyric acid
  mod_res (10)..(10): L or I
  mod_res (14)..(14): L or I
  mod_res (18)..(18): L or I
  mod_res (20)..(20): L or I
XAGXAXQXLXAAVXAPVXVXQQF

SEQ ID NO: 3018 - protein, 23 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (10)..(10): L or I
  mod_res (14)..(14): L or I
  mod_res (18)..(18): Aminoisobutyric acid
  mod_res (20)..(20): L or I
BAGABBQBLXAAVXAPVBVXQQF

SEQ ID NO: 3019 - protein, 22 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (10)..(10): L or I
  mod_res (11)..(11): Aminoisobutyric acid
  mod_res (14)..(14): L or I
  misc_feature (18)..(18): Xaa can be any naturally occurring amino acid
  mod_res (20)..(20): Aminoisobutyric acid
XAGAXXQXLXXGLXAPVXAQQF

SEQ ID NO: 3020 - protein, 18 aa, Artificial
  Peptide with targeting and/or antimicrobial activity
  mod_res (1)..(1): Aminoisobutyric acid
  mod_res (5)..(6): Aminoisobutyric acid
  mod_res (8)..(9): Aminoisobutyric acid
  mod_res (13)..(14): Aminoisobutyric acid
  misc_feature (15)..(15): Xaa can be any naturally occurring amino acid
XASAXXQXXGAPVXXQQF

SEQ ID NO: 3021 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (9)..(9): L or I
  mod_res (10)..(10): Aminoisobutyric acid
  mod_res (12)..(12): L or I
  mod_res (13)..(13): Aminoisobutyric acid
  mod_res (16)..(17): Aminoisobutyric acid
XAGAXXQXXXGXXPVXXQQF

SEQ ID NO: 3022 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (9)..(9): L or I
  mod_res (10)..(10): Aminoisobutyric acid
  mod_res (12)..(12): L or I
  mod_res (13)..(13): Aminoisobutyric acid
  mod_res (16)..(17): Aminoisobutyric acid
XASAXXQXXXGXXPVXXQQF

SEQ ID NO: 3023 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (9)..(9): L or I
  mod_res (10)..(10): Aminoisobutyric acid
  mod_res (12)..(12): L or I
  mod_res (16)..(17): Aminoisobutyric acid
XAGAXXQXXXGXAPVXXQQF

SEQ ID NO: 3024 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (9)..(9): L or I
  mod_res (10)..(10): Aminoisobutyric acid
  mod_res (12)..(12): L or I
  mod_res (13)..(13): Aminoisobutyric acid
  mod_res (16)..(16): Aminoisobutyric acid
  mod_res (17)..(17): L or I
XAGAXXQXXXGXXPVXXQQF

SEQ ID NO: 3025 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XASAXXQXLXGLXPVXXQQF

SEQ ID NO: 3026 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAAAXXQXLXGLXPVXXQQF

SEQ ID NO: 3027 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
XAAAXXQXIXGLXPVXAQQF

SEQ ID NO: 3028 - protein, 20 aa, Artificial
  Peptide with targeting and/or antimicrobial activity
  mod_res (1)..(1): Aminoisobutyric acid
  mod_res (6)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAAAAXQXIXGLXPVXXQQF

SEQ ID NO: 3029 - protein, 20 aa, Artificial
  Peptide with targeting and/or antimicrobial activity
  mod_res (1)..(1): Aminoisobutyric acid
  mod_res (5)..(6): Aminoisobutyric acid
  misc_feature (8)..(8): Xaa can be any naturally occurring amino acid
  mod_res (10)..(10): Aminoisobutyric acid
  mod_res (13)..(13): Aminoisobutyric acid
  mod_res (16)..(17): Aminoisobutyric acid
XAAAXXQXVXGLXPVXXQQF

SEQ ID NO: 3030 - protein, 20 aa, Artificial
  Peptide with targeting and/or antimicrobial activity
  mod_res (1)..(1): Aminoisobutyric acid
  mod_res (5)..(6): Aminoisobutyric acid
  misc_feature (8)..(8): Xaa can be any naturally occurring amino acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAAAXXQXLXGLXPVXXQQF

SEQ ID NO: 3031 - protein, 20 aa, Artificial
  Peptide with targeting and/or antimicrobial activity
  mod_res (1)..(1): Aminoisobutyric acid
  misc_feature (3)..(3): Xaa can be any naturally occurring amino acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAXAXXQXVXGLXPVXXQQF

SEQ ID NO: 3032 - protein, 20 aa, Artificial
  Peptide with targeting and/or antimicrobial activity
  mod_res (1)..(1): Aminoisobutyric acid
  mod_res (5)..(6): Aminoisobutyric acid
  misc_feature (8)..(8): Xaa can be any naturally occurring amino acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAAAXXQXVXGLXPVXXQQF

SEQ ID NO: 3033 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(17): Aminoisobutyric acid
XAAAXXQXIXGLXPVXXQQF

SEQ ID NO: 3034 - protein, 20 aa, Artificial
  Peptide with targeting and/or antimicrobial activity
  mod_res (1)..(1): Aminoisobutyric acid
  mod_res (3)..(3): Aminoisobutyric acid
  mod_res (5)..(6): Aminoisobutyric acid
  misc_feature (8)..(8): Xaa can be any naturally occurring amino acid
  mod_res (10)..(10): Aminoisobutyric acid
  mod_res (13)..(13): Aminoisobutyric acid
  mod_res (16)..(17): Aminoisobutyric acid
XAXAXXQXIXGLXPVXXQQF

SEQ ID NO: 3035 - protein, 20 aa, Artificial
  Peptide with targeting and/or antimicrobial activity
  mod_res (1)..(1): Aminoisobutyric acid
  mod_res (5)..(6): Aminoisobutyric acid
  mod_res (8)..(8): Aminoisobutyric acid
  mod_res (10)..(10): Aminoisobutyric acid
  mod_res (13)..(13): Aminoisobutyric acid
  mod_res (16)..(16): Aminoisobutyric acid
  mod_res (17)..(17): Isovaline
XAAAXXQXIXGLXPVXXQQF

SEQ ID NO: 3036 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (11)..(12): Aminoisobutyric acid
  mod_res (15)..(15): Aminoisobutyric acid
  mod_res (16)..(16): Isovaline
XGXLXEXXXAXXPLXXQV

SEQ ID NO: 3037 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(8): Aminoisobutyric acid
  mod_res (11)..(12): Aminoisobutyric acid
  mod_res (15)..(16): Aminoisobutyric acid
XGXLXQXXAAXXPLXXEV

SEQ ID NO: 3038 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (12)..(12): Aminoisobutyric acid
  mod_res (15)..(16): Aminoisobutyric acid
XGXLXQXXXAAXPLXXEV

SEQ ID NO: 3039 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(8): Aminoisobutyric acid
  mod_res (11)..(12): Aminoisobutyric acid
  mod_res (15)..(15): Aminoisobutyric acid
  mod_res (16)..(16): Isovaline
XGXLXQXXAAXXPLXXEV

SEQ ID NO: 3040 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (11)..(12): Aminoisobutyric acid
  mod_res (15)..(16): Aminoisobutyric acid
XGXLXQXXXAXXPLXXEV

SEQ ID NO: 3041 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (11)..(12): Aminoisobutyric acid
  mod_res (15)..(15): Aminoisobutyric acid
  mod_res (16)..(16): Isovaline
XGXLXQXXXAXXPLXXEV

SEQ ID NO: 3042 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (11)..(12): Aminoisobutyric acid
  mod_res (15)..(16): Aminoisobutyric acid
XAXLXQXXXAXXPLXXEV

SEQ ID NO: 3043 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (12)..(12): Aminoisobutyric acid
  mod_res (15)..(16): Aminoisobutyric acid
XGXLXQXXXAAXPLXXQV

SEQ ID NO: 3044 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(8): Aminoisobutyric acid
  mod_res (11)..(11): Aminoisobutyric acid
  misc_feature (12)..(12): Xaa can be any naturally occurring amino acid
  mod_res (15)..(15): Aminoisobutyric acid
  mod_res (16)..(16): Isovaline
XGXLXQXXAAAXPLXXQV

SEQ ID NO: 3045 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (12)..(12): Aminoisobutyric acid
  mod_res (15)..(15): Aminoisobutyric acid
  mod_res (16)..(16): Isovaline
XGXLXQXXXAAXPLXXQV

SEQ ID NO: 3046 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (12)..(12): Aminoisobutyric acid
  mod_res (15)..(15): Aminoisobutyric acid
  mod_res (16)..(16): Isovaline
XAXLXQXXXAAXPLXXQV

SEQ ID NO: 3047 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (11)..(12): Aminoisobutyric acid
  mod_res (15)..(15): Aminoisobutyric acid
  mod_res (16)..(16): Isovaline
XGXLXQXXXAXXPLXXQV

SEQ ID NO: 3048 - protein, 18 aa, Artificial
  Peptide with targeting and/or antimicrobial activity
  mod_res (1)..(1): Aminoisobutyric acid
  mod_res (3)..(3): Aminoisobutyric acid
  mod_res (5)..(5): Aminoisobutyric acid
  mod_res (7)..(9): Aminoisobutyric acid
  mod_res (11)..(12): Aminoisobutyric acid
  mod_res (15)..(15): Aminoisobutyric acid
  mod_res (16)..(16): Isovaline
XAXLXQXXXAXXPLXXQV

SEQ ID NO: 3049 - protein, 18 aa, Artificial
  Peptide with targeting and/or antimicrobial activity
  mod_res (1)..(1): Aminoisobutyric acid
  misc_feature (7)..(7): Xaa can be any naturally occurring amino acid
  mod_res (9)..(9): Aminoisobutyric acid
  mod_res (11)..(12): Aminoisobutyric acid
  mod_res (15)..(16): Aminoisobutyric acid
XGALAQXVXGXXPLXXQL

SEQ ID NO: 3050 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XGALXQAVXGXXPLXXQL

SEQ ID NO: 3051 - protein, 18 aa, Artificial
  Peptide with targeting and/or antimicrobial activity
  mod_res (1)..(1): Aminoisobutyric acid
  mod_res (7)..(7): Aminoisobutyric acid
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XGALAQXVXGXXPLXXQL

SEQ ID NO: 3052 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Aminoisobutyric acid
  mod_res (9)..(9): Aminoisobutyric acid
  mod_res (11)..(12): Aminoisobutyric acid
  mod_res (15)..(16): Aminoisobutyric acid
XGALXQXVXGXXPLXXQL

SEQ ID NO: 3053 - protein, 18 aa, Artificial
  Peptide with targeting and/or antimicrobial activity
  mod_res (1)..(1): Aminoisobutyric acid
  mod_res (5)..(5): Aminoisobutyric acid
  misc_feature (7)..(7): Xaa can be any naturally occurring amino acid
  mod_res (9)..(9): Aminoisobutyric acid
  mod_res (11)..(12): Aminoisobutyric acid
  mod_res (15)..(16): Aminoisobutyric acid
XGALXQXVXGXXPLXXQL

SEQ ID NO: 3054 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Isovaline
  mod_res (9)..(9): Aminoisobutyric acid
  mod_res (11)..(12): Aminoisobutyric acid
  mod_res (15)..(16): Aminoisobutyric acid
XGALXQXVXGXXPLXXQL

SEQ ID NO: 3055 - protein, 18 aa, Artificial
  Peptide with targeting and/or antimicrobial activity
  misc_feature (1)..(1): Xaa can be any naturally occurring amino acid
  misc_feature (5)..(5): Xaa can be any naturally occurring amino acid
  misc_feature (7)..(9): Xaa can be any naturally occurring amino acid
  misc_feature (11)..(12): Xaa can be any naturally occurring amino acid
  misc_feature (15)..(16): Xaa can be any naturally occurring amino acid
XGALXQXXXGXXPLXXQL

SEQ ID NO: 3056 - protein, 18 aa, Artificial
  Peptide with targeting and/or antimicrobial activity
  mod_res (1)..(1): Aminoisobutyric acid
  mod_res (5)..(5): Isovaline
  mod_res (7)..(7): Isovaline
  mod_res (9)..(9): Aminoisobutyric acid
  mod_res (11)..(12): Aminoisobutyric acid
  mod_res (15)..(16): Aminoisobutyric acid
XGALXQXVXGXXPLXXQL

SEQ ID NO: 3057 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Aminoisobutyric acid
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XGALXQXVXGXXPLXXQL

SEQ ID NO: 3058 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Isovaline
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XGALXQXVXGXXPLXXQL

SEQ ID NO: 3059 - protein, 18 aa, Artificial
  Peptide with targeting and/or antimicrobial activity
  mod_res (1)..(1): Aminoisobutyric acid
  mod_res (5)..(5): Aminoisobutyric acid
  mod_res (7)..(7): Isovaline
  mod_res (9)..(9): Aminoisobutyric acid
  mod_res (11)..(11): Isovaline
  misc_feature (12)..(12): Xaa can be any naturally occurring amino acid
  mod_res (15)..(16): Aminoisobutyric acid
XGALXQXLXGXXPLXXQL

SEQ ID NO: 3060 - protein, 18 aa, Artificial
  Peptide with targeting and/or antimicrobial activity
  mod_res (1)..(1): Aminoisobutyric acid
  mod_res (5)..(5): Isovaline
  mod_res (7)..(7): Isovaline
  mod_res (9)..(9): Aminoisobutyric acid
  mod_res (11)..(11): Isovaline
  mod_res (12)..(12): Aminoisobutyric acid
  mod_res (15)..(16): Aminoisobutyric acid
XGALXQXVXGXXPLXXQL

SEQ ID NO: 3061 - protein, 19 aa, Artificial
  Peptide with targeting and/or antimicrobial activity
  mod_res (1)..(1): Aminoisobutyric acid
  mod_res (4)..(4): Aminoisobutyric acid
  mod_res (7)..(9): Aminoisobutyric acid
  mod_res (12)..(12): Aminoisobutyric acid
  mod_res (15)..(15): Aminoisobutyric acid
XGAXIQXXXSLXPVXIQQL

SEQ ID NO: 3062 - protein, 11 aa, Artificial
  Peptide with targeting and/or antimicrobial activity
  mod_res (1)..(1): Aminoisobutyric acid
  mod_res (4)..(4): Aminoisobutyric acid
  mod_res (7)..(7): Aminoisobutyric acid
  misc_feature (8)..(8): Xaa can be any naturally occurring amino acid
XGVXGGVXGIL

SEQ ID NO: 3063 - protein, 11 aa, Artificial
  Peptide with targeting and/or antimicrobial activity
  mod_res (1)..(1): Isovaline
  mod_res (4)..(4): Aminoisobutyric acid
  mod_res (7)..(7): Aminoisobutyric acid
  misc_feature (8)..(8): Xaa can be any naturally occurring amino acid
XGVXGGVXGIL

SEQ ID NO: 3064 - protein, 15 aa, Artificial
  Peptide with targeting and/or antimicrobial activity
  mod_res (3)..(3): Aminoisobutyric acid
  mod_res (4)..(4): Isovaline
  mod_res (8)..(8): Aminoisobutyric acid
  mod_res (10)..(10): Aminoisobutyric acid
  mod_res (13)..(13): Aminoisobutyric acid
WVXXAQAXSXALXQL

SEQ ID NO: 3065 - protein, 15 aa, Artificial
  Peptide with targeting and/or antimicrobial activity
  mod_res (3)..(4): Aminoisobutyric acid
  mod_res (8)..(8): Aminoisobutyric acid
  mod_res (10)..(10): Aminoisobutyric acid
  mod_res (13)..(13): Aminoisobutyric acid
WVXXAQAXSXALXQL

SEQ ID NO: 3066 - protein, 17 aa, Artificial
  Peptide with targeting and/or antimicrobial activity
  mod_res (2)..(2): Isovaline
  mod_res (4)..(4): Aminoisobutyric acid
  mod_res (7)..(7): Aminoisobutyric acid
  mod_res (9)..(9): Aminoisobutyric acid
  mod_res (12)..(12): Aminoisobutyric acid
  mod_res (13)..(13): Hydroxyproline
  mod_res (14)..(14): Isovaline
WXQXITXLXPQXXXPFG

SEQ ID NO: 3067 - protein, 17 aa, Artificial
  Peptide with targeting and/or antimicrobial activity
  mod_res (4)..(4): Aminoisobutyric acid
  mod_res (7)..(7): Aminoisobutyric acid
  mod_res (9)..(9): Aminoisobutyric acid
  mod_res (12)..(12): Aminoisobutyric acid
  mod_res (14)..(14): Aminoisobutyric acid
  mod_res (17)..(17): Hydroxyproline
WIAXIVXLXPAXPXPFX

SEQ ID NO: 3068 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIEXVTXLXXQXXXPF

SEQ ID NO: 3069 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WVEXITXLXXQXXXPF

SEQ ID NO: 3070 - protein, 16 aa, Artificial
  Peptide with targeting and/or antimicrobial activity
  mod_res (4)..(4): Aminoisobutyric acid
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIEXITXLXXQXXXPF

SEQ ID NO: 3071 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIEXITXLXXQXXXPF

SEQ ID NO: 3072 - protein, 16 aa, Artificial
  Peptide with targeting and/or antimicrobial activity
  mod_res (4)..(4): Aminoisobutyric acid
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIQXVTXLXXQXXXPF

SEQ ID NO: 3073 - protein, 16 aa, Artificial
  Peptide with targeting and/or antimicrobial activity
  mod_res (4)..(4): Aminoisobutyric acid
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIQXITXVXXQXXXPF

SEQ ID NO: 3074 - protein, 16 aa, Artificial
  Peptide with targeting and/or antimicrobial activity
  mod_res (4)..(4): Aminoisobutyric acid
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Hydroxyproline
WVQXITXLXXQXXXPF

SEQ ID NO: 3075 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIQXVTXLXXQXXXPF

SEQ ID NO: 3076 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIQXITXVXXQXXXPF

SEQ ID NO: 3077 - protein, 16 aa, Artificial
  Peptide with targeting and/or antimicrobial activity
  mod_res (4)..(4): Aminoisobutyric acid
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIQXITXLXXQXXXPF

SEQ ID NO: 3078 - protein, 16 aa, Artificial
  Peptide with targeting and/or antimicrobial activity
  mod_res (4)..(4): Isovaline
  mod_res (7)..(7): Aminoisobutyric acid
  mod_res (9)..(9): Aminoisobutyric acid
  mod_res (10)..(10): Hydroxyproline
  mod_res (12)..(12): Aminoisobutyric acid
  mod_res (13)..(13): Hydroxyproline
  mod_res (14)..(14): Aminoisobutyric acid
WIQXITXLXXQXXXPF

SEQ ID NO: 3079 - protein, 15 aa, Artificial
  Peptide with targeting and/or antimicrobial activity
GWRLIKKILRVFKGL

SEQ ID NO: 3080 - protein, 16 aa, Artificial
  Peptide with targeting and/or antimicrobial activity
KNLRIIRKGIHIIKKY

SEQ ID NO: 3081 - protein, 11 aa, Artificial
  Peptide with targeting and/or antimicrobial activity
FKKFWKWFRRF

SEQ ID NO: 3082 - protein, 11 aa, Artificial
  Peptide with targeting and/or antimicrobial activity
LKRFLKWFKRF

SEQ ID NO: 3083 - protein, 11 aa, Artificial
  Peptide with targeting and/or antimicrobial activity
KLFKRWKHLFR

SEQ ID NO: 3084 - protein, 11 aa, Artificial
  Peptide with targeting and/or antimicrobial activity
RLLKRFKHLFK

SEQ ID NO: 3085 - protein, 11 aa, Artificial
  Peptide with targeting and/or antimicrobial activity
FKTFLKWLHRF

SEQ ID NO: 3086 - protein, 11 aa, Artificial
  Peptide with targeting and/or antimicrobial activity
IKQLLHFFQRF

SEQ ID NO: 3087 - protein, 11 aa, Artificial
  Peptide with targeting and/or antimicrobial activity
KLLQTFKQIFR

SEQ ID NO: 3088 - protein, 11 aa, Artificial
  Peptide with targeting and/or antimicrobial activity
RILKELKNLFK

SEQ ID NO: 3089 - protein, 11 aa, Artificial
  Peptide with targeting and/or antimicrobial activity
LKQFVHFIHRF

SEQ ID NO: 3090 - protein, 11 aa, Artificial
  Peptide with targeting and/or antimicrobial activity
VKTLLHIFQRF

SEQ ID NO: 3091 - protein, 11 aa, Artificial
  Peptide with targeting and/or antimicrobial activity
KLVEQLKEIFR

SEQ ID NO: 3092 - protein, 11 aa, Artificial
  Peptide with targeting and/or antimicrobial activity
RVLQEIKQILK

SEQ ID NO: 3093 - protein, 11 aa, Artificial
  Peptide with targeting and/or antimicrobial activity
VKNLAELVHRF

SEQ ID NO: 3094 - protein, 11 aa, Artificial
  Peptide with targeting and/or antimicrobial activity
ATHLLHALQRF

SEQ ID NO: 3095 - protein, 11 aa, Artificial
  Peptide with targeting and/or antimicrobial activity
KLAENVKEILR

SEQ ID NO: 3096 - protein, 11 aa, Artificial
  Peptide with targeting and/or antimicrobial activity
RALHEAKEALK

SEQ ID NO: 3097 - protein, 11 aa, Artificial
  Peptide with targeting and/or antimicrobial activity
FHYFWHWFHRF

SEQ ID NO: 3098 - protein, 11 aa, Artificial
  Peptide with targeting and/or antimicrobial activity
LYHFLHWFQRF

SEQ ID NO: 3099 - protein, 11 aa, Artificial
  Peptide with targeting and/or antimicrobial activity
YLFQTWQHLFR

SEQ ID NO: 3100 - protein, 11 aa, Artificial
  Peptide with targeting and/or antimicrobial activity
YLLTEFQHLFK

SEQ ID NO: 3101 - protein, 11 aa, Artificial
  Peptide with targeting and/or antimicrobial activity
FKTFLQWLHRF

SEQ ID NO: 3102 - protein, 11 aa, Artificial
  Peptide with targeting and/or antimicrobial activity
IKTLLHFFQRF

SEQ ID NO: 3103 - protein, 11 aa, Artificial
  Peptide with targeting and/or antimicrobial activity
KLLQTFNQIFR

SEQ ID NO: 3104 - protein, 11 aa, Artificial
  Peptide with targeting and/or antimicrobial activity
TILQSLKNIFK

SEQ ID NO: 3105 - protein, 11 aa, Artificial
  Peptide with targeting and/or antimicrobial activity
LKQFVKFIHRF

SEQ ID NO: 3106 - protein, 11 aa, Artificial
  Peptide with targeting and/or antimicrobial activity
VKQLLKIFNRF

SEQ ID NO: 3107 - protein, 11 aa, Artificial
  Peptide with targeting and/or antimicrobial activity
KLVQQLKNIFR

SEQ ID NO: 3108 - protein, 11 aa, Artificial
  Peptide with targeting and/or antimicrobial activity
RVLNQVKQILK

SEQ ID NO: 3109 - protein, 11 aa, Artificial
  Peptide with targeting and/or antimicrobial activity
VKKLAKLVRRF

SEQ ID NO: 3110 - protein, 11 aa, Artificial
  Peptide with targeting and/or antimicrobial activity
AKRLLKVLKRF

SEQ ID NO: 3111 - protein, 11 aa, Artificial
  Peptide with targeting and/or antimicrobial activity
KLAQKVKRVLR

SEQ ID NO: 3112 - protein, 11 aa, Artificial
  Peptide with targeting and/or antimicrobial activity
RALKRIKHVLK

SEQ ID NO: 3113 - protein, 7 aa, Artificial
  Peptide with targeting and/or antimicrobial activity
RRRRWWW

SEQ ID NO: 3114 - protein, 7 aa, Artificial
  Peptide with targeting and/or antimicrobial activity
RRWWRRW

SEQ ID NO: 3115 - protein, 7 aa, Artificial
  Peptide with targeting and/or antimicrobial activity
RRRWWWR

SEQ ID NO: 3116 - protein, 7 aa, Artificial
  Peptide with targeting and/or antimicrobial activity
RWRWRWR

SEQ ID NO: 3117 - protein, 7 aa, Artificial
  Peptide with targeting and/or antimicrobial activity
RRRFWWR

SEQ ID NO: 3118 - protein, 7 aa, Artificial
  Peptide with targeting and/or antimicrobial activity
RRWWRRF

SEQ ID NO: 3119 - protein, 7 aa, Artificial
  Peptide with targeting and/or antimicrobial activity
RRRWWWF

SEQ ID NO: 3120 - protein, 7 aa, Artificial
  Peptide with targeting and/or antimicrobial activity
RWRWRWF

SEQ ID NO: 3121 - protein, 7 aa, Artificial
  Peptide with targeting and/or antimicrobial activity
RRRRWWK

SEQ ID NO: 3122 - protein, 7 aa, Artificial
  Peptide with targeting and/or antimicrobial activity
RRWWRRK

SEQ ID NO: 3123 - protein, 7 aa, Artificial
  Peptide with targeting and/or antimicrobial activity
RRRWWWK

SEQ ID NO: 3124 - protein, 7 aa, Artificial
  Peptide with targeting and/or antimicrobial activity
RWRWRWK

SEQ ID NO: 3125 - protein, 7 aa, Artificial
  Peptide with targeting and/or antimicrobial activity
RRRKWWK

SEQ ID NO: 3126 - protein, 7 aa, Artificial
  Peptide with targeting and/or antimicrobial activity
RRWKRRK

SEQ ID NO: 3127 - protein, 7 aa, Artificial
  Peptide with targeting and/or antimicrobial activity
RRRKWWK

SEQ ID NO: 3128 - protein, 7 aa, Artificial
  Peptide with targeting and/or antimicrobial activity
RWRKRWK

SEQ ID NO: 3129 - protein, 14 aa, Artificial
  Peptide with targeting and/or antimicrobial activity
LHLLHQLLHLLHQF

SEQ ID NO: 3130 - protein, 14 aa, Artificial
  Peptide with targeting and/or antimicrobial activity
AQAAHQAAHAAHQF

SEQ ID NO: 3131 - protein, 14 aa, Artificial
  Peptide with targeting and/or antimicrobial activity
KLKKLLKKLKKLLK

SEQ ID NO: 3132 - protein, 14 aa, Artificial
  Peptide with targeting and/or antimicrobial activity
LKLLKKLLKLLKKF

SEQ ID NO: 3133 - protein, 14 aa, Artificial
  Peptide with targeting and/or antimicrobial activity
LQLLKQLLKLLKQF

SEQ ID NO: 3134 - protein, 14 aa, Artificial
  Peptide with targeting and/or antimicrobial activity
AQAAKQAAKAAKQF

SEQ ID NO: 3135 - protein, 14 aa, Artificial
  Peptide with targeting and/or antimicrobial activity
RWRRWWRHFHHFFH

SEQ ID NO: 3136 - protein, 14 aa, Artificial
  Peptide with targeting and/or antimicrobial activity
KLKKLLKRWRRWWR

SEQ ID NO: 3137 - protein, 14 aa, Artificial
  Peptide with targeting and/or antimicrobial activity
RWRRLLKKLHHLLH

SEQ ID NO: 3138 - protein, 14 aa, Artificial
  Peptide with targeting and/or antimicrobial activity
KLKKLLKHLHHLLH

SEQ ID NO: 3139 - protein, 15 aa, Artificial
  Peptide with targeting and/or antimicrobial activity
FVFRHKWVWKHRFLF

SEQ ID NO: 3140 - protein, 15 aa, Artificial
  Peptide with targeting and/or antimicrobial activity
VFIHRHVWVHKHVLF

SEQ ID NO: 3141 - protein, 15 aa, Artificial
  Peptide with targeting and/or antimicrobial activity
WRWRARWRWRLRWRF

SEQ ID NO: 3142 - protein, 15 aa, Artificial
  Peptide with targeting and/or antimicrobial activity
WRIHLRARLHVKFRF

SEQ ID NO: 3143 - protein, 15 aa, Artificial
  Peptide with targeting and/or antimicrobial activity
LRIHARFKVHIRLKF

SEQ ID NO: 3144 - protein, 15 aa, Artificial
  Peptide with targeting and/or antimicrobial activity
FHIKFRVHLKVRFHF

SEQ ID NO: 3145 - protein, 15 aa, Artificial
  Peptide with targeting and/or antimicrobial activity
FHVKIHFRLHVKFHF

SEQ ID NO: 3146 - protein, 15 aa, Artificial
  Peptide with targeting and/or antimicrobial activity
LHIHAHFHVHIHLHF

SEQ ID NO: 3147 - protein, 15 aa, Artificial
  Peptide with targeting and/or antimicrobial activity
FKIHFRLKVHIRFKF

SEQ ID NO: 3148 - protein, 15 aa, Artificial
  Peptide with targeting and/or antimicrobial activity
FKAHIRFKLRVKFHF

SEQ ID NO: 3149 - protein, 15 aa, Artificial
  Peptide with targeting and/or antimicrobial activity
LKAKIKFKVKLKIKF

SEQ ID NO: 3150 - protein, 14 aa, Artificial
  Peptide with targeting and/or antimicrobial activity
WIWKHKFLHRHFLF

SEQ ID NO: 3151 - protein, 14 aa, Artificial
  Peptide with targeting and/or antimicrobial activity
VFLHRHVIKHKLVF

SEQ ID NO: 3152 - protein, 13 aa, Artificial
  Peptide with targeting and/or antimicrobial activity
FLHKHVLRHRIVF

SEQ ID NO: 3153 - protein, 13 aa, Artificial
  Peptide with targeting and/or antimicrobial activity
VFKHKIVHRHILF

SEQ ID NO: 3154 - protein, 13 aa, Artificial
  Peptide with targeting and/or antimicrobial activity
FLFKHLFLHRIFF

SEQ ID NO: 3155 - protein, 12 aa, Artificial
  Peptide with targeting and/or antimicrobial activity
LFKHILIHRVIF

SEQ ID NO: 3156 - protein, 12 aa, Artificial
  Peptide with targeting and/or antimicrobial activity
FLHKHLFKHKLF

SEQ ID NO: 3157 - protein, 12 aa, Artificial
  Peptide with targeting and/or antimicrobial activity
VFRHRFIHRHVF

SEQ ID NO: 3158 - protein, 12 aa, Artificial
  Peptide with targeting and/or antimicrobial activity
FIHKLVHKHVLF

SEQ ID NO: 3159 - protein, 12 aa, Artificial
  Peptide with targeting and/or antimicrobial activity
VLRHLFRHRIVF

SEQ ID NO: 3160 - protein, 12 aa, Artificial
  Peptide with targeting and/or antimicrobial activity
LVHKLILRHLLF

SEQ ID NO: 3161 - protein, 12 aa, Artificial
  Peptide with targeting and/or antimicrobial activity
VFKRVLIHKLIF

SEQ ID NO: 3162 - protein, 12 aa, Artificial
  Peptide with targeting and/or antimicrobial activity
IVRKFLFRHKVF

SEQ ID NO: 3163 - protein, 12 aa, Artificial
  Peptide with targeting and/or antimicrobial activity
VLKHVIAHKRLF

SEQ ID NO: 3164 - protein, 11 aa, Artificial
  Peptide with targeting and/or antimicrobial activity
FIRKFLFKHLF

SEQ ID NO: 3165 - protein, 11 aa, Artificial
  Peptide with targeting and/or antimicrobial activity
VIRHVWVRKLF

SEQ ID NO: 3166 - protein, 13 aa, Artificial
  Peptide with targeting and/or antimicrobial activity
FLFRHRFRHRLVF

SEQ ID NO: 3167 - protein, 13 aa, Artificial
  Peptide with targeting and/or antimicrobial activity
LFLHKHAKHKFLF

SEQ ID NO: 3168 - protein, 11 aa, Artificial
  Peptide with targeting and/or antimicrobial activity
FKHKFKHKFIF

SEQ ID NO: 3169 - protein, 11 aa, Artificial
  Peptide with targeting and/or antimicrobial activity
LRHRLRHRLIF

SEQ ID NO: 3170 - protein, 11 aa, Artificial
  Peptide with targeting and/or antimicrobial activity
LILKFLFKFVF

SEQ ID NO: 3171 - protein, 11 aa, Artificial
  Peptide with targeting and/or antimicrobial activity
VLIRILVRVIF

SEQ ID NO: 3172 - protein, 9 aa, Artificial
  Peptide with targeting and/or antimicrobial activity
FRHRFRHRF

SEQ ID NO: 3173 - protein, 9 aa, Artificial
  Peptide with targeting and/or antimicrobial activity
LKHKLKHKF

SEQ ID NO: 3174 - protein, 9 aa, Artificial
  Peptide with targeting and/or antimicrobial activity
FKFKHKLIF

SEQ ID NO: 3175 - protein, 9 aa, Artificial
  Peptide with targeting and/or antimicrobial activity
LRLRHRVLF

SEQ ID NO: 3176 - protein, 9 aa, Artificial
  Peptide with targeting and/or antimicrobial activity
FKFLFKFLF

SEQ ID NO: 3177 - protein, 9 aa, Artificial
  Peptide with targeting and/or antimicrobial activity
LRLFLRWLF

SEQ ID NO: 3178 - protein, 9 aa, Artificial
  Peptide with targeting and/or antimicrobial activity
FKFLFKHKF

SEQ ID NO: 3179 - protein, 9 aa, Artificial
  Peptide with targeting and/or antimicrobial activity
LRLFLRHRF

SEQ ID NO: 3180 - protein, 7 aa, Artificial
  Peptide with targeting and/or antimicrobial activity
FKFLFKF

SEQ ID NO: 3181 - protein, 7 aa, Artificial
  Peptide with targeting and/or antimicrobial activity
LRLFLRF

SEQ ID NO: 3182 - protein, 14 aa, Artificial
  Peptide with targeting and/or antimicrobial activity
HHFFHHFHHFFHHF

SEQ ID NO: 3183 - protein, 14 aa, Artificial
  Peptide with targeting and/or antimicrobial activity
FHFFHHFFHFFHHF

SEQ ID NO: 3184 - protein, 21 aa, Artificial
  Peptide with targeting and/or antimicrobial activity
KLLKGATFHFFHHFFHFFHHF

SEQ ID NO: 3185 - protein, 18 aa, Artificial
  Peptide with targeting and/or antimicrobial activity
KLLKFHFFHHFFHFFHHF

SEQ ID NO: 3186 - protein, 18 aa, Artificial
  Peptide with targeting and/or antimicrobial activity
FHFFHHFFHFFHHFKLLK

SEQ ID NO: 3187 - protein, 7 aa, Artificial
  Peptide with targeting and/or antimicrobial activity
YSPWTNF

SEQ ID NO: 3188 - protein, 18 aa, Artificial
  Peptide with targeting and/or antimicrobial activity
GSQLVYREWVGHSNVIKP

SEQ ID NO: 3189 - protein, 20 aa, Artificial
  Peptide with targeting and/or antimicrobial activity
GSQLVYREWVGHSNVIKGPP

SEQ ID NO: 3190 - protein, 37 aa, Artificial; identical to SEQ ID NO: 1910
  Peptide with targeting and/or antimicrobial activity

SEQ ID NO: 3191 - protein, 14 aa, Artificial
  Peptide with targeting and/or antimicrobial activity
  misc_feature (14)..(14): Xaa can be any naturally occurring amino acid
FKRIVQRIKDFLRX

SEQ ID NO: 3192 - protein, 15 aa, Artificial
  Peptide with targeting and/or antimicrobial activity
  misc_feature (1)..(1): Xaa can be any naturally occurring amino acid
  misc_feature (15)..(15): Xaa can be any naturally occurring amino acid
XRLFDKIRQVIRKFX

SEQ ID NO: 3193 - protein, 37 aa, Artificial; identical to SEQ ID NO: 1910
  Peptide with targeting and/or antimicrobial activity

SEQ ID NO: 3194 - protein, 38 aa, Artificial
  Peptide with targeting and/or antimicrobial activity
CLLGDFFRKSKEKIGKEFKRIVQRIKDFLRNLVPRTES

SEQ ID NO: 3195 - protein, 16 aa, Artificial
  Peptide with targeting and/or antimicrobial activity
FKRIVQRIKDFLRNLV

SEQ ID NO: 3196 - protein, 39 aa, Artificial
  Peptide with targeting and/or antimicrobial activity
CLLGDFFRKSKEKIGKEFKRIVQRIKDFLRNLVPRTESC

SEQ ID NO: 3197 - protein, 13 aa, Artificial
  Peptide with targeting and/or antimicrobial activity
FKRIVQRIKDFLR

SEQ ID NO: 3198 - protein, 21 aa, Artificial
  Peptide with targeting and/or antimicrobial activity
FKRIVQRIKDFLRNLVPRTES

SEQ ID NO: 3199 - protein, 21 aa, Artificial
  Peptide with targeting and/or antimicrobial activity
GKEFKRIVQRIKDFLRNLVPR

SEQ ID NO: 3200 - protein, 20 aa, Artificial
  Peptide with targeting and/or antimicrobial activity
KRIVQRIKDFLRNLVPRTES

SEQ ID NO: 3201 - protein, 21 aa, Artificial
  Peptide with targeting and/or antimicrobial activity
LLGDFFRKSKEKIGKEFKRIV

SEQ ID NO: 3202 - protein, 31 aa, Artificial; identical to SEQ ID NO: 2450
  Peptide with targeting and/or antimicrobial activity

SEQ ID NO: 3203 - protein, 21 aa, Artificial
  Peptide with targeting and/or antimicrobial activity
SKEKIGKEFKRIVQRIKDFLR

SEQ ID NO: 3204 - protein, 38 aa, Artificial
  Peptide with targeting and/or antimicrobial activity
LLGDFFRKSKEKIGKEFKRIVQRIKDFLRNLVPRTESC

SEQ ID NO: 3205 - protein, 8 aa, Artificial
  Peptide with targeting and/or antimicrobial activity
DYKDDDDK

SEQ ID NO: 3206 - protein, 4 aa, Artificial
  Peptide with targeting and/or antimicrobial activity
HHHH

SEQ ID NO: 3207 - protein, 5 aa, Artificial
  Peptide with targeting and/or antimicrobial activity
HHHHH

SEQ ID NO: 3208 - protein, 6 aa, Artificial
  Peptide with targeting and/or antimicrobial activity
HHHHHH

SEQ ID NO: 3209 - protein, 5 aa, Artificial
  Peptide with targeting and/or antimicrobial activity
PSGSP

SEQ ID NO: 3210 - protein, 5 aa, Artificial
  Peptide with targeting and/or antimicrobial activity
ASASA

SEQ ID NO: 3211 - protein, 15 aa, Artificial
  Peptide with targeting and/or antimicrobial activity
GGGGSGGGGSGGGGS

SEQ ID NO: 3212 - protein, 4 aa, Artificial
  Peptide with targeting and/or antimicrobial activity
GGGG

SEQ ID NO: 3213 - protein, 6 aa, Artificial
  Peptide with targeting and/or antimicrobial activity
GGSGGS

SEQ ID NO: 3214 - protein, 5 aa, Artificial
  Peptide with targeting and/or antimicrobial activity
PSPSP

SEQ ID NO: 3215 - protein, 5 aa, Artificial
  Peptide with targeting and/or antimicrobial activity
ASASA

SEQ ID NO: 3216 - protein, 5 aa, Artificial
  Peptide with targeting and/or antimicrobial activity
PSPSP

SEQ ID NO: 3217 - protein, 4 aa, Artificial
  Peptide with targeting and/or antimicrobial activity
KKKK

SEQ ID NO: 3218 - protein, 4 aa, Artificial
  Peptide with targeting and/or antimicrobial activity
RRRR

SEQ ID NO: 3219 - protein, 5 aa, Artificial
  Peptide with targeting and/or antimicrobial activity
GGGGS

SEQ ID NO: 3220 - protein, 10 aa, Artificial
  Peptide with targeting and/or antimicrobial activity
GGGGSGGGGS

SEQ ID NO: 3221 - protein, 15 aa, Artificial
  Peptide with targeting and/or antimicrobial activity
GGGGSGGGGSGGGGS

SEQ ID NO: 3222 - protein, 20 aa, Artificial
  Peptide with targeting and/or antimicrobial activity
GGGGSGGGGSGGGGSGGGGS

SEQ ID NO: 3223 - protein, 25 aa, Artificial
  Peptide with targeting and/or antimicrobial activity
GGGGSGGGGSGGGGSGGGGSGGGGS

SEQ ID NO: 3224 - protein, 30 aa, Artificial
  Peptide with targeting and/or antimicrobial activity
GGGGSGGGGSGGGGSGGGGSGGGGSGGGGS

SEQ ID NO: 3225 - protein, 29 aa, Artificial
  Peptide with targeting and/or antimicrobial activity
KFINGVLSQFVLERKPYPKLFKFLRKHLL

SEQ ID NO: 3226 - protein, 11 aa, Artificial
  Peptide with targeting and/or antimicrobial activity
FIRKFLKKWLL

SEQ ID NO: 3227 - protein, 11 aa, Artificial
  Peptide with targeting and/or antimicrobial activity
TFFRFLNRGGG

SEQ ID NO: 3228 - protein, 23 aa, Artificial
  Peptide with targeting and/or antimicrobial activity
TFFRFLNRGGGKFIRKFLKKWLL

SEQ ID NO: 3229 - protein, 15 aa, Artificial
  Peptide with targeting and/or antimicrobial activity
KKHRKHRKHRKHGGG

SEQ ID NO: 3230 - protein, 28 aa, Artificial
  Peptide with targeting and/or antimicrobial activity
FIKHFIHRFGGGKNLRIIRKGIHIIKKY

SEQ ID NO: 3231 - protein, 33 aa, Artificial
  Peptide with targeting and/or antimicrobial activity
TFFRLFNRSFTQALGKGGGFLKFLKKFFKKLKY

SEQ ID NO: 3232 - protein, 29 aa, Artificial
  Peptide with targeting and/or antimicrobial activity
KFINGVLSQFVLERKPYPKLFKFLRKHLL

SEQ ID NO: 3233 - protein, 22 aa, Artificial
  Peptide with targeting and/or antimicrobial activity
NIFEYFLEGGGKLFKFLRKHLL

SEQ ID NO: 3234 - protein, 45 aa, Artificial
  Peptide with targeting and/or antimicrobial activity
GKAKPYQVRQVLRAVDKLETRRKKGGRPYPGWRLIKKILRVFKGL

SEQ ID NO: 3235 - protein, 41 aa, Artificial
  Peptide with targeting and/or antimicrobial activity
SKRGRKRKDRRKKKANHGKRPNSGGGGWRLIKKILRVFKGL

SEQ ID NO: 3236 - protein, 23 aa, Artificial
  Peptide with targeting and/or antimicrobial activity
YSKTLHFADGGGKILKFLFKKVF

SEQ ID NO: 3237 - protein, 37 aa, Artificial
  Peptide with targeting and/or antimicrobial activity
SKRGRKRKDRRKKKANHGKRPNSGGGKILKFLFKKVF

SEQ ID NO: 3238 - protein, 46 aa, Artificial
  Peptide with targeting and/or antimicrobial activity
GSVIKKRRKRMSKKKHRKMLRRTRVQRRKLGKGGGKILKFLFKKVF

What is claimed is:

1. A chimeric construct, said construct comprising:
a targeting peptide that binds *S. mutans*, and that ranges in length up to 51 amino acids, where the amino acid sequence of said targeting peptide comprises the amino acid sequence KFINGVLSQFVLERK (SEQ ID NO:15), where said targeting peptide is attached to an effector selected from the group consisting of an antimicrobial peptide, an antibiotic, a lipid or liposome, a photosensitizing agent, and a polymeric particle.

2. The chimeric construct of claim 1, wherein the amino acid sequence of said targeting peptide consists of the sequence KFINGVLSQFVLERK (SEQ ID NO:15).

3. The chimeric construct of claim 1 or 2, wherein said targeting peptide is attached to an antimicrobial peptide.

4. The chimeric construct of claim 3, wherein said targeting peptide is attached to an antimicrobial peptide selected from the group consisting of GLGRVIGRLIKQIIWRR (SEQ ID NO: 1029), VYRKRKSILKIYAKLKGWH (SEQ ID NO: 1030), NYRLVNAIFSKIFKKKFIKF (SEQ ID NO: 1031), KILKFLFKKVF (SEQ ID NO: 1032), FIRKFLKKWLL (SEQ ID NO: 1033), KLFKFLRKHLL (SEQ ID NO: 1034), KILKFLFKQVF (SEQ ID NO: 1035), KILKKLFKFVF (SEQ ID NO: 1036), GILKKLFTKVF (SEQ ID NO: 1037), LRKFLHKLF (SEQ ID NO: 1038), LRKNLRWLF (SEQ ID NO: 1039), FIRKFLQKLHL (SEQ ID NO: 1040), FTRKFLKFLHL (SEQ ID NO: 1041), KKFKKFKVLKIL (SEQ ID NO: 1042), LLKLLKLKKLKF (SEQ ID NO: 1043), FLKFLKKFFKKLKY (SEQ ID NO: 1044), GWLKMFKKIIGKFGKF (SEQ ID NO: 1045), GIFKKFVKILYKVQKL (SEQ ID NO: 1046), GRLVLEITADEVKALGEALANAKI (SEQ ID NO: 1047), YIQFHLNQQPRPKVKKIKIFL-NH2 (SEQ ID NO: 1048), GSVIKKRRKRMAKKKHRKLLKK-TRIQRRRAGK (SEQ ID NO: 1049), MRFGSLALVAYD-SAIKHSWPRPSSVRRLRM (SEQ ID NO: 1050), FESKIL-NASKELDKEKKVNTALSFNSHQDFAKAYQNGKI (SEQ ID NO: 1051), WSRVPGHSDTGWKVWHRW-NH2 (SEQ ID NO: 1052), MGIIAGIIKFIKGLIEKFTGK (SEQ ID NO: 1053), RESKLIAMADMIRRRI-NH2 (SEQ ID NO: 1054), LSLATFAKIFMTRSNWSLKRFNRL (SEQ ID NO: 1055), MIRIRSPTKKKLNRNSISDWKSNTSGRFFY (SEQ ID NO: 1056), MKRRRCNWCGKLFYLEEK-SKEAYCCKECRKKAKKVKK (SEQ ID NO: 1057), VLPFPAIPLSRRRACVAAPRPRSRQRAS (SEQ ID NO: 1058), KNKKQTDILEKVKEILDKKKKTKSVGQKLY (SEQ ID NO: 1059), SLQSQLGPCLHDQRH (SEQ ID NO: 1060), KFQGEFTNIGQSYIVSASHMSTSLNTGK (SEQ ID NO: 1061), TKKIELKRFVDAFVKKSYENYILER-ELKKLIKAINEELPTK (SEQ ID NO: 1062), KFSDQID-KGQDALKDKLGDL (SEQ ID NO: 1063), LSEMERRRL-RKRA-NH2 (SEQ ID NO: 1064), RRGCTERLRRMARRNAWDLYAEHFY (SEQ ID NO: 1065), SKFKVLRKIIIKEYKGELMLSIQKQR (SEQ ID NO: 1066), FELVDWLETNLGKILKSKSA-NH2 (SEQ ID NO: 1067), LVLRICTDLFTFIKWTIKQRKS (SEQ ID NO: 1068), VYSFLYVLVIVRKLLSMKKRIERL (SEQ ID NO: 1069), GIVLIGLKLIPLLANVLR (SEQ ID NO: 1070), VMQSLYVKPPLILVTKLAQQN (SEQ ID NO: 1071), SFMPEIQKNTIPTQMK (SEQ ID NO: 1072), LGLT-AGVAYAAQPTNQPTNQPTNQPTNQPTNQPTNQPRW (SEQ ID NO: 1073), CGKLLEQKNFFLKTR (SEQ ID NO: 1074), ASKQASKQASKQASKQASKQASRSLKNHLL (SEQ ID NO: 1075), PDAPRTCYHKPILAALSRIVVTDR (SEQ ID NO: 1076), NYAVVSHT (SEQ ID NO: 1077), FQKPFTGEEVEDFQDDDEIPTII (SEQ ID NO:1078), DSSQSDSDSDSNSSNTNSNSSITNG (SEQ ID NO: 1079), LPGTLHIQAEFPVQLEAGSLIQIFD (SEQ ID NO: 1080), EIPIQLANDLANYYDISLDSIFFW (SEQ ID NO: 1081), RDMTVAGKRPNFLIITTDEE (SEQ ID NO: 1082), NTSIVCAVTFAPIKEVPLLWRAGLTLRSRQS (SEQ ID NO: 1083), QAKVEREVERDLVYTLRRLCDPSGSERTK (SEQ ID NO: 1084), PRMIDIISFHGCHGDHQVWTD-PQATALPR (SEQ ID NO: 1085), MNNWIIVAQLSVTVI-NEIIDIMKEKQKGGK (SEQ ID NO: 1086), NDDAQ (SEQ ID NO: 1087), MNNWIKVAQISVTVINEVI-DIMKEKQNGGK (SEQ ID NO: 1088), ARLSKAIIIAVIV-VYHLDVRGLF (SEQ ID NO: 1089), MESIFKIKLMNGI-CRSENMNMKKKNKGEKI (SEQ ID NO: 1090), MGIIAGIIKFIKGLIEKFTGK (SEQ ID NO: 1091), MGI-IAGIIKVIKSLIEQFTGK (SEQ ID NO: 1092), MIEIG-SIAYLNGGSKKYNHILNQENR (SEQ ID NO: 1093), SKKYNHILNQENR (SEQ ID NO: 1094), MDID-VNKLLQAFVYFKSFEKLRHNNS (SEQ ID NO: 1095), MFCYYKQHKGDNFSIEEVKNIIADNEMKVN (SEQ ID NO: 1096), WRGPNTEAGGKSANNIVQVGGAPT (SEQ ID NO: 1097), LIQKGLNQTFIVVIRLNNFIKKS (SEQ ID NO: 1098), SIDKRNLYNLKYYE (SEQ ID NO: 1099), ESIIE (SEQ ID NO: 1100), NDTNK (SEQ ID NO: 1101), MKIILLLFLIFGFIVVVTLKSEHQLTLFSI (SEQ ID NO: 1102), FSLNFSKQKYVTVN (SEQ ID NO: 1103), MINELKNKNSGIMNNYVVTKESKL (SEQ ID NO: 1104), MTKNTIISLENEKTQINDSENESSDLRKAK (SEQ ID NO: 1105), DLRKAK (SEQ ID NO: 1106), LLII-FRLWLELKWKNKK (SEQ ID NO: 1107), SIHFIN (SEQ ID NO: 1108), HNARKYLEFISQKIDGDKLTKEDSL (SEQ ID NO: 1109), ALDC(SEQSVILWYETILDKIVG-VIK (SEQ ID NO: 1110), NSTNE (SEQ ID NO: 1111), MTCHQAPTTTHQSNMA (SEQ ID NO: 1112), MPHH-STTSSRIVVPAHQSNMASTPNLSITP (SEQ ID NO: 1113), RIVVPAHQSNMASTPNLSITP (SEQ ID NO: 1114), MFIFKTTSKSHFHNNVKSLECIKIPINKNR (SEQ ID NO: 1115), EPKKKHFPKMESASSEP (SEQ ID NO: 1116), SFYESY (SEQ ID NO: 1117), ILNRLSRIVS-NEVTSLIYSLK (SEQ ID NO: 1118), MTKKRRYDTTEF-GLAHSMTAKITLHQALYK (SEQ ID NO: 1119), MIHLT-KQNTMEALHFIKQFYDMFFILNFNV (SEQ ID NO:

1120), ELLVILPGFI (SEQ ID NO: 1121), LLLSYFRYT-GALLQSLF (SEQ ID NO: 1122), MIKNETAYQM-NELLVIRSAYAK (SEQ ID NO: 1123), LDINDYRSTY (SEQ ID NO: 1124), LDFYLTKHLTLML (SEQ ID NO: 1125), LYFAFKKYQERVNQAPNIEY (SEQ ID NO: 1126), AYYLKRREEKGK (SEQ ID NO: 1127), RFFNFEIKKST-KVDYVFAHVDLSDV (SEQ ID NO: 1128), QELINEAVN-LLVKSK (SEQ ID NO: 1129), KLFGQWGPELGSIYIL-PALIGSIILIAIVTLILRAMRK (SEQ ID NO: 1130), AEQLFGKQKQRGVDLFLNRLTIILSIL-FFVLMICISYLGM (SEQ ID NO: 1131), TMIVISIPR-FEEYMKARHKKWM (SEQ ID NO: 1132), FADQSDNA (SEQ ID NO: 1133), TITLKAGIERAL-HEEVPGVIEVEQVF (SEQ ID NO: 1134), GYN-SYKAVQDVKTHSEEQRVTAKK (SEQ ID NO: 1135), IAAIIVLVLFQKGLLQIFNWILIQLQ (SEQ ID NO: 1136), DYYGKE (SEQ ID NO: 1137), LEKNTRDNYFIHAIDRIY-INTSKGLFPESELVAWG (SEQ ID NO: 1138), IKGTVKAVDETTVVITVNGHGTELTFEKPAIKQVDPS (SEQ ID NO: 1139), DLIVKVHICFVVKTASGY-CYLNKREAQAAI (SEQ ID NO: 1140), SHLINNFGLS-VINPSTPICLNFSPVFNLLTVYGITCN (SEQ ID NO: 1141), FDPVPLKKDKSASKHSHKHNH (SEQ ID NO: 1142), SMVKSEIVDLLNGEDNDD (SEQ ID NO: 1143), HCVIGNVVDIANLLKRRAVYRDIADVIKMR (SEQ ID NO: 1144), CPSVTMDACALLQKFDFCNNISHFRHF-FAIKQPIER (SEQ ID NO: 1145), RDIHPIYFMTKD (SEQ ID NO: 1146), FVNSLIMKDLSDNDMRFKYEYYN-REKDT (SEQ ID NO: 1147), LYQYELLSKEEYLKCTLI-INQRRNEQK (SEQ ID NO: 1148), EIIAYLEGRFANA (SEQ ID NO: 1149), TTRPQVAEDRQLDDALKETFPAS-DPISP (SEQ ID NO: 1150), MADGQIAAIAKLHGVP-VATRNIRHFQSFGVELINPWSG (SEQ ID NO: 1151), YVVGALVILAVAGLIYSMLRKA (SEQ ID NO: 1152), MLRYLSLFAVGLATGYAWGWIDGLAASLAV (SEQ ID NO: 1153), GIKVVAARFEEIQFSENFDSIILA (SEQ ID NO: 1154), MKLLARDPWVCAWNDIW (SEQ ID NO: 1155), GDPTAGQKPVECP (SEQ ID NO: 1156), PPAR-PARIPQTPTLHGASLFRQRS (SEQ ID NO: 1157), VLGKGHDLLDVGKTALKSRVFAWLGGS (SEQ ID NO: 1158), ALSKPAIQARTLCRRQDPP (SEQ ID NO: 1159), FHRRVIRASEWALTTRSFSTPLRSAAR (SEQ ID NO: 1160), LSPRPIIVSRRSRADNNNDWSR (SEQ ID NO: 1161), RSGQPVGRPSRRAWLR (SEQ ID NO: 1162), GIV-LTGRAGLVSGACSMALGVGLG (SEQ ID NO: 1163), RRGCTERLRRMARRNAWDLYAEHFY (SEQ ID NO: 1164), GKVSVLTRVPRSLGGAPANQ (SEQ ID NO: 1165), GILARADCSQIA (SEQ ID NO: 1166), LITAEQPATA-PIAGK (SEQ ID NO: 1167), HTAVVWLAGVSGCVALSH-CEPA (SEQ ID NO: 1168), EEVSRALAGIGLGLGCRIG (SEQ ID NO: 1169), VLPFPAIPLSR-RRACVAAPRPRSRQRAS (SEQ ID NO: 1170), TQVTL-CRTW (SEQ ID NO: 1171), AGRTAIVQGGG (SEQ ID NO: 1172), RRRPAGQRPEKASQAMIAA (SEQ ID NO: 1173), RLTSNQFLTRITPFVFAQH (SEQ ID NO: 1174), EVYSSPTNNVAITVQNN (SEQ ID NO: 1175), SGLGDLGFSSEAK (SEQ ID NO: 1176), DADKNLSLER-DRFAWRVAAP (SEQ ID NO: 1177), ARTFAGRLGTRY-FGGLMRSTKA (SEQ ID NO: 1178), HFILRKPLLFMIH-SLKTGPLDRF (SEQ ID NO: 1179), QFCNFAWLFLASNNAQVSALA (SEQ ID NO: 1180), VEEDEAPPPHY (SEQ ID NO: 1181), TTARYIR-RQCHTSITPLSQG (SEQ ID NO: 1182), FPAFSFGAIAGS-VSVAR (SEQ ID NO: 1183), SWKCHHLAI (SEQ ID NO: 1184), ALQKQDMNLPSVKNQLVFLKSTG (SEQ ID NO: 1185), DAYHCHLVRSPDAHDLSMRIGFV (SEQ ID NO: 1186), NYAVVSHT (SEQ ID NO: 1187), NDSKASN (SEQ ID NO: 1188), ELKITNYNVNTVLYRYYKWGNDLCE (SEQ ID NO: 1189), VDPADDGTRHIRPEDGDPIEIDE (SEQ ID NO: 1190), DYFYITLSQKNTF (SEQ ID NO: 1191), LMFFSENMDKRDTLSGKFRYFAGSK-VIKLMNWLSENGK (SEQ ID NO: 1192), DANAMART-TIAIVYILALIALTISYSL (SEQ ID NO: 1193), RTPYILRS (SEQ ID NO: 1194), GIPFSKPHKRQVNYMKSDV-LAYIEQNKMAHTA (SEQ ID NO: 1195), INSRYKISF (SEQ ID NO: 1196), SEDIFGRLANEKANGLEEL-RKIRLKQ (SEQ ID NO: 1197), DHKINESQHNPFRSD-SNKQNVDFF (SEQ ID NO: 1198), VWENRKKYLE-NEIERHNVFLKLGQEVIKGLNALASRGR (SEQ ID NO: 1199), MQSLSNRQSLIASYILMGIFLSFGYP-PASLSKFFCRLSHL (SEQ ID NO: 1200), MYLTPYAWIA-VGSIFAFSVTTIKIGDQNDEKQKSHKNDVHKR (SEQ ID NO: 1201), AAQPQTTSP (SEQ ID NO: 1202), LVGAL-LIFVALIYMVLKGNADKN (SEQ ID NO: 1203), SIQE-AEKIIKNDPFYIHDVADYDFMWFEPSKSLEEIKEFV (SEQ ID NO: 1204), LDLALSTNSLNLEGFSF (SEQ ID NO: 1205), LSLATFAKIFMTRSNWSLKRFNRL (SEQ ID NO: 1206), MIRIRSPTKKKLNRNSISDWKSNTSGRFFY (SEQ ID NO: 1207), MGRHLWNPSYFVATVSENTE-EQIRKYRKNK (SEQ ID NO: 1208), MVHDMTNGTLI-IVKH (SEQ ID NO: 1209), SFVSTTVRLIFEESKRYKF (SEQ ID NO: 1210), YDPLK (SEQ ID NO: 1211), DFLVN-FLWFKGELNWGKKRYK (SEQ ID NO: 1212), GAFG-MPSIKTNTICGEKGKFISACDAWLSNLK (SEQ ID NO: 1213), ISKGIDDIVYVINKILSIGNIFKIIKRK (SEQ ID NO: 1214), GIVLIGLKLIPLLANVLN (SEQ ID NO: 1215), EYPWSWISEPWPWDKSFYK (SEQ ID NO: 1216), MREWICPSCNETHDRDINASINILKEGLRLITIQNK (SEQ ID NO: 1217), GCILPHKKDNYNYIMSKFQDLV-KITSKK (SEQ ID NO: 1218), MKRRRCNWCGKL-FYLEEKSKEAYCCKECRKKAKKVKK (SEQ ID NO: 1219), GVALIGTILVPLLSGLFG (SEQ ID NO: 1220), YIT-SHKNARAIIKKFERDEILEEVITHYLNRK (SEQ ID NO: 1221), MGRHLWNPSYFVATVSENTEEQIRKYIN-NQKKQVK (SEQ ID NO: 1222), SIGSMIGMYSFRHKT-KHIKFTFGIPFILFLQFLLVYFYILK (SEQ ID NO: 1223), GIVLIGLKLIPLLANVLR (SEQ ID NO: 1224), AAYPIED-WSDWYEDFFIMLSNI (SEQ ID NO: 1225), KKIDIL-INKYMYLSK (SEQ ID NO: 1226), AFSGVYK-TLIVYTRRK (SEQ ID NO: 1227), DERLPEAKAIRNFNGSVMVLGR (SEQ ID NO: 1228), GIFTGVTVVVSLKHC (SEQ ID NO: 1229), MPKSCH-VPVLCDFFFLVIIKFLALFKTIQS (SEQ ID NO: 1230), LAVILRAIVY (SEQ ID NO: 1231), FTFSKCRASNGRGF-GTLWL (SEQ ID NO: 1232), WIAIGLLLYFSLKNQ (SEQ ID NO: 1233), VSIKIGAIVIGMIGLMELLTE (SEQ ID NO: 1234), MLTIIIGFIFWTMTLMLGYLIGEREGRKHE (SEQ ID NO: 1235), MEQKVKVIFVPRSKPDNQLKTFVSAV-LFKA (SEQ ID NO: 1236), NIERILKEKVWMIRCVE (SEQ ID NO: 1237), SMLSVTVMCLMHASVAAN-QAMEKKV (SEQ ID NO: 1238), ALCSVIKAIELGIIN-VHLQ (SEQ ID NO: 1239), MSEAVNLLRGARYSQRY-AKNQVPYEVIIEK (SEQ ID NO: 1240), VIFLHKESGNLKEIFY (SEQ ID NO: 1241), HFYLLFER (SEQ ID NO: 1242), HLFFVKGMFILCQKNQINDE (SEQ ID NO: 1243), MDSAKAQTMRTDWLAVSCLVASAYL-RSMLA (SEQ ID NO: 1244), MTVFEALMLA-IAFATLIVKISNKNDKK (SEQ ID NO: 1245), ESAK-SNLNFLMQEEWALFLLL (SEQ ID NO: 1246), VFVVLFIIYLASKLLTKLFPIKK (SEQ ID NO: 1247), KKIIPLITLFVVTLVG (SEQ ID NO: 1248), QGANPC-QQVGFTVNDPDCRLAKTV (SEQ ID NO: 1249), KYKC-SWCKRVYTLRKDHKTAR (SEQ ID NO: 1250), WSEIE-INTKQSN (SEQ ID NO: 1251),

MIKKSILKIKYYVPVLISLTLILSA (SEQ ID NO: 1252), FTLTLITTIVAILNYKDKKK (SEQ ID NO: 1253), GAVGIAFFAGNMKQDKRIADRQNKKSEKK (SEQ ID NO: 1254), GLQFKEIAEEFHITTTALQQWHKDNGYPIYNKNNRK (SEQ ID NO: 1255), VVAYVITQVGAIRF (SEQ ID NO: 1256), DPAGCNDIVRKYCK (SEQ ID NO: 1257), DLVQSILSEFKKSG (SEQ ID NO: 1258), VLKEECYQKN (SEQ ID NO: 1259), YCVPLGNMGNMNNKIW (SEQ ID NO: 1260), LIYTILASLGVLTVLQAILGREPKAVKA (SEQ ID NO: 1261), VEDLMEDLNA (SEQ ID NO: 1262), ILVVLAGILLVVLSYVGISKFKMNC (SEQ ID NO: 1263), FPIISALLGAIICIAIYSFIVNRKA (SEQ ID NO: 1264), YWLSRVTTGHSFAFEKPVPLSLTIK (SEQ ID NO: 1265), LLSTEQLLKYYDGETFDGFQLPSNE (SEQ ID NO: 1266), VLYFQATVV (SEQ ID NO: 1267), LVRIEVDDLEEWYERNFI (SEQ ID NO: 1268), YLEMNADYLSNMDIFDELWEKYLENNK (SEQ ID NO: 1269), KPKNKKEKTVISYEKLLSMY (SEQ ID NO: 1270), YCVPLGNMGNMNNKIW (SEQ ID NO: 1271), FALELIALCRNLFIVYFP (SEQ ID NO: 1272), WVAVAILLNIALQTQLT (SEQ ID NO: 1273), TFAGSIKIGVPDLVHVTFNCKR (SEQ ID NO: 1274), LLNKKLE (SEQ ID NO: 1275), MIDVTIGQKSKTGAFNASYSICFSGENFSF (SEQ ID NO: 1276), SKAGLYGKIERSDKRE (SEQ ID NO: 1277), DSYFRS (SEQ ID NO: 1278), FFLVHFYIRKRKGKVSIFLNYF (SEQ ID NO: 1279), VVTGKVGSLPQIK (SEQ ID NO: 1280), KHCFEITDKTDVV (SEQ ID NO: 1281), MSRKKYENDEKSQKKLKIGRKSDVFYGIID (SEQ ID NO: 1282), AGKKERLLSFREQFLNKNKKK (SEQ ID NO: 1283), IAAFVTSRAFSDTVSPI (SEQ ID NO: 1284), MMELVLKTIIGPIVVGVVLRIVDKWLNKDK (SEQ ID NO: 1285), MLQKYTQMISVTKCIITKNKKTQENVDAYN (SEQ ID NO: 1286), YVLEYHGLRATQDVDAFMAL (SEQ ID NO: 1287), ENEESIF (SEQ ID NO: 1288), AATLICVGSGIMSSL (SEQ ID NO: 1289), AVVCGYLAYTATS (SEQ ID NO: 1290), VAYAAICWW (SEQ ID NO: 1291), FNGDSEFFLCIAF (SEQ ID NO: 1292), MRKEFHNVLSSGQLLADKRPARDYNRK (SEQ ID NO: 1293), GQLLADKRPARDYNRK (SEQ ID NO: 1294), FQKPFTGEEVEDFQDDDEIPTII (SEQ ID NO: 1295), RVLVLKKFHGIMDGNRNVAVFFVGQ (SEQ ID NO: 1296), MFIISPDLFNIAVILYILFFIHDILLLILS (SEQ ID NO: 1297), MQIFYIKTKIFLSFFLFLLIFSQCFYKIEE (SEQ ID NO: 1298), KLLYFFNYFENLQQVHLLVQL (SEQ ID NO: 1299), MAAKLWEEGKMVYASSASMTKRLKLAMSKV (SEQ ID NO: 1300), ASMTKRLKLAMSKV (SEQ ID NO: 1301), SGNEKV (SEQ ID NO: 1302), IDKSRNKDQFSHIFGLYNICSG (SEQ ID NO: 1303), SLQSQLGPCLHDQRH (SEQ ID NO: 1304), MPTTKSKQKGWTNTKKASNTQ (SEQ ID NO: 1305), HRNLIILQRTIFI (SEQ ID NO: 1306), MVNYIIGSYMLYREQNNNEALRKFDITLAM (SEQ ID NO: 1307), MNNWIKVAQISVTVINEVIDIMKEKQNGGK (SEQ ID NO: 1308), IIQDIAHAFGY (SEQ ID NO: 1309), MSVFVPVTNIFMFIMSPIFNVNLLHFKVYI (SEQ ID NO: 1310), MARNDDDIKKIKGTLGQSPEVYGERKLPYT (SEQ ID NO: 1311), TCVKPRTIN (SEQ ID NO: 1312), INKYHHIA (SEQ ID NO: 1313), ISLIIFIMLFVVALFKCITNYKHQS (SEQ ID NO: 1314), EKRMSFNENQSHRPLL (SEQ ID NO: 1315), MEHVLPFQNTPPNIVIIYKDFTHLKSITFS (SEQ ID NO: 1316), MTLAIKNCSVTKCLGFGDFVNDDSDSYFDA (SEQ ID NO: 1317), KNKTDTL (SEQ ID NO: 1318), VDMVNRFLGN (SEQ ID NO: 1319), KPVGKALEEIADGKIEPVVPKEYLG (SEQ ID NO: 1320), VRKSDQ (SEQ ID NO: 1321), YYKDYFKEI (SEQ ID NO: 1322), EDNKDKKDKKDK (SEQ ID NO: 1323), YKVNYNNIDNHFNTLRH (SEQ ID NO: 1324), PYSDSYATRPHWEQHRAR (SEQ ID NO: 1325), MVGKIRGVTPRNDLLNANITGQLNLNYRLI (SEQ ID NO: 1326), MHISHLLDEVEQTEREKAVNVLENMNGNVI (SEQ ID NO: 1327), MAADIISTIGDLVKWIIDTVNKFKK (SEQ ID NO: 1328), MHRNLVLVKMEPIPHIMIIANQIGIIIEKA (SEQ ID NO: 1329), MREKVRFTQAFKLFWTNYFNFKGRSRRSEY (SEQ ID NO: 1330), WADAQYKLCENCSE (SEQ ID NO: 1331), HKNKLNIPHIKS (SEQ ID NO: 1332), HLFILKSHLKPFPPFRYTYD (SEQ ID NO: 1333), AYILKRREEKNK (SEQ ID NO: 1334), MVEILVNTAISVYIVALYTQWLSTRDNLKA (SEQ ID NO: 1335), LVGYVRTSGTVRSYKIN (SEQ ID NO: 1336), HKKDIRKQVFKN (SEQ ID NO: 1337), KNSMSRSIALID (SEQ ID NO: 1338), VMQSLYVKPPLILVTKLAQQN (SEQ ID NO: 1339), SFMPEIQKNTIPTQMK (SEQ ID NO: 1340), SNGVGLGVGIGSGIRF-NH2 (SEQ ID NO: 1341), QRFYKLFYHIDLTNEQALKLFQVK (SEQ ID NO: 1342), DKSTQDKDIKQAKLLAQELGL-NH2 (SEQ ID NO: 1343), ASKQASKQASKQASKQ (SEQ ID NO: 1344), VKPTMTASLISTVC (SEQ ID NO: 1345), SFYSKYSRYIDNLAGAIFLFF (SEQ ID NO: 1346), YLVYSGVLATAAAF-NH2 (SEQ ID NO: 1347), LGLTAGVAYAAQPTNQPTNQPTNQPTNQPTNQPRW-NH2 (SEQ ID NO: 1348), CGKLLEQKNFFLKTR (SEQ ID NO: 1349), FELVDWLETNLGKILKSKSA-NH2 (SEQ ID NO: 1350), PDAPRTCYHKPILAALSRIVVTDR (SEQ ID NO: 1351), KFSDQIDKGQDALKDKLGDL (SEQ ID NO: 1352), VLLLFIFQPFQKQLL-NH2 (SEQ ID NO: 1353), GSVIKKRRKRMAKKKHRKLLKKTRIQRRRAGK (SEQ ID NO: 1354), LVDVVVLIRRHLPKSCS-NH2 (SEQ ID NO: 1355), LSEMERRRLRKRA-NH2 (SEQ ID NO: 1356), SKFKVLRKIIIKEYKGELMLSIQKQR (SEQ ID NO: 1357), YIQFHLNQQPRPKVKKIKIFL-NH2 (SEQ ID NO: 1358), KFIYKYKLSFIIYKILIQTLTMELNK (SEQ ID NO: 1359), KTPNDKIHKTIIIKHIIL (SEQ ID NO: 1360), KYFHLFYHNIIHYSKQHLSLKVDFKN-NH2 (SEQ ID NO: 1361), NIKTRKRALKIIKQHQRSK (SEQ ID NO: 1362), MEPIPHIMIIANQIGIIIEKA (SEQ ID NO: 1363), LANDYYKKTKKSW (SEQ ID NO: 1364), KNKKQTDILEKVKEILDKKKKTKSVGQKLY (SEQ ID NO: 1365), SIILTKKKRRKIPLSIDSQIYKYTFKQ (SEQ ID NO: 1366), KSILILIKVIFIGQTTIIL (SEQ ID NO: 1367), RRNLNSPNIKTRKRALKIIKQHQRSK (SEQ ID NO: 1368), KKDNPSLNDQDKNAVLNLLALAK (SEQ ID NO: 1369), NILFGIIGFVVAMTAAVIVTAISIAK (SEQ ID NO: 1370), FGEKQMRSWWKVHWFHP (SEQ ID NO: 1371), RESKLIAMADMIRRRI-NH2 (SEQ ID NO: 1372), PIIAPTIKTQIQ (SEQ ID NO: 1373), WSRVPGHSDTGWKVWHRW-NH2 (SEQ ID NO: 1374), ARPIADLIHFNSTIVTASGDVYYGPG (SEQ ID NO: 1375), TGIGPIARPIEHGLDS (SEQ ID NO: 1376), STENGWQEFESYADVGVDPRRYVPL (SEQ ID NO: 1377), QVKEKRREIELQFRDAEKKLEASVQAE (SEQ ID NO: 1378), ELDKADAALGPAKNLAPLDVINRS (SEQ ID NO: 1379), LTIVGNALQQKNQKLLLNQKKITSLG (SEQ ID NO: 1380), AKNFLTRTAEEIGEQAVREGNINGP (SEQ ID NO: 1381), EAYMRFLDREMEGLTAAYNVKLFTEAIS (SEQ ID NO: 1382), SLQIRMNTLTAAKASIEAA (SEQ ID NO: 1383), AANKAREQAAAEAKRKAEEQAR (SEQ ID NO: 1384), ADAPPPLIVRYS (SEQ ID NO: 1385), SRPGKPGGVSIDVSRDRQDILSNYP (SEQ ID NO: 1386), FGNPFRGFTLAMEADFKKRK (SEQ ID NO: 1387), ESLEADVQAELDTEAAKYPALPASF (SEQ ID NO: 1388), TPEQWLERSTVVVTGLLNRK (SEQ ID NO: 1389),

RPELDNELDVVQNSASLDKLQASYN (SEQ ID NO: 1390), TIILNDQINSLQERLNKLNAETDRR (SEQ ID NO: 1391), RAEAEAQRQAEADAKRKAEEAARL (SEQ ID NO: 1392), EAQQVTQQLGADFNAITTPTATKV (SEQ ID NO: 1393), QQRVKAVDASLSQVSTQVSGAVASA (SEQ ID NO: 1394), KSKISEYTEKEFLEFVEDIYTNNK (SEQ ID NO: 1395), SDLLYYPNENREDSPAGVVKEVKE (SEQ ID NO: 1396), WRASKGLPGFKAG (SEQ ID NO: 1397), EKKLIVKLIDSIGKSHEEIVGAG (SEQ ID NO: 1398), LVKSGKLESPYEHSEHLTLSQEKGLE (SEQ ID NO: 1399), LNFRAENKILEKIHISLIDTVEGSA (SEQ ID NO: 1400), AYSGELPEPLVRKMSKEQVRSVMGK (SEQ ID NO: 1401), PFETRESFRVPVIGILGGWDYFMHP (SEQ ID NO: 1402), QKANLRIGFTYTSDSNVCNLTFALLGSK (SEQ ID NO: 1403), EILNNNQVIKELTMKYKTQFESNLGGWTARARR (SEQ ID NO: 1404), WTARARR (SEQ ID NO: 1405), NLKTIEKECPFCNNKMDIKLKD (SEQ ID NO: 1406), KFQGEFTNIGQSYIVSASHMSTSLNTGK (SEQ ID NO: 1407), SYIKNLSNQKFLIAF (SEQ ID NO: 1408), DYNHLLNVVQDWVNTN (SEQ ID NO: 1409), FFNQANYFFKEF (SEQ ID NO: 1410), ASGKYQSYLLNVYVDSKKDRLDIFDKLKAKAKFVL (SEQ ID NO: 1411), ESVEAIKAKAIK (SEQ ID NO: 1412), APLRIDEIRNSNVIDEVLDCAPKKQEHFFVVPKIIE (SEQ ID NO: 1413), YYQAKLFPLL (SEQ ID NO: 1414), DLLKSLLGQDGAKNDEIIEFIKIIMEK (SEQ ID NO: 1415), IMKNYKYFKLFIVKYALF (SEQ ID NO: 1416), MEISTLKKEKLHVKDELSQYLANYKK (SEQ ID NO: 1417), IVSAIV (SEQ ID NO: 1418), LQNKIYELLYIKERSKLCS (SEQ ID NO: 1419), SKMWDKILTILILILELIRELIKL (SEQ ID NO: 1420), DEIKVSDEEIEKFIKENNL (SEQ ID NO: 1421), MKFMLEVRNKAISAYKEITRTQI (SEQ ID NO: 1422), LFEIFKPKH (SEQ ID NO: 1423), TKKIELKRFVDAFVKKSYENYILERELKKLIKAINEELPTK (SEQ ID NO: 1424), YRVTVKALE (SEQ ID NO: 1425), LEKEKKEYIEKLFKTK (SEQ ID NO: 1426), IDKLKKMNLQKLSYEVRISQDGKSIYARIK (SEQ ID NO: 1427), LMEQVEV (SEQ ID NO: 1428), HYRWNTQWWKY (SEQ ID NO: 1429), FESKILNASKELDKEKKVNTALSFNSHQDFAKAYQNGKI (SEQ ID NO: 1430), YIESDPRKFDYIFGAIRDH (SEQ ID NO: 1431), TEIKLDNNEYLVLNLDDILGILK (SEQ ID NO: 1432), VFLKLKTSKIDLASIIFYP (SEQ ID NO: 1433), GTTLKYGLERQLKIDIHPEITIINLNGGADEFAKL (SEQ ID NO: 1434), ADEFAKL (SEQ ID NO: 1435), GLDIYA (SEQ ID NO: 1436), FLNRFIFYIFTVKTKSALIKNLFLD (SEQ ID NO: 1437), IVFVVTKEKK (SEQ ID NO: 1438), PMNAAEPE (SEQ ID NO: 1439), KLNTLNKKDNPSLNDQDKNAVLNLLALAK (SEQ ID NO: 1440), WSRVPGHSDTGWKVWHRW (SEQ ID NO: 1441), PPSSFLV (SEQ ID NO: 1442), TREDVFSVRLINNIVNKQA (SEQ ID NO: 1443), VLFAVYLGALDWLFSWLTQKM (SEQ ID NO: 1444), VFLLDSYCFVKINL (SEQ ID NO: 1445), SDSTNNARTRKKARDVTTKDIDK (SEQ ID NO: 1446), KYDFDDFEPEEA (SEQ ID NO: 1447), INDLLSYFTLHEK (SEQ ID NO: 1448), GLAAIATVFALY (SEQ ID NO: 1449), IPATPIIHS (SEQ ID NO: 1450), LIIYFSKTGNTARATRQI (SEQ ID NO: 1451), TTIQGVASLEKHGFRYTIIYPTRI (SEQ ID NO: 1452), MPKARPVNHNKKKSKITIKSNFTLFYMFNP (SEQ ID NO: 1453), MNAHGHSLIFQKMIVHAFAFFSKQKNYLYF (SEQ ID NO: 1454), LVRLA (SEQ ID NO: 1455), SRIKQDARSVRKYDRIGIFFYSFKSA (SEQ ID NO: 1456), TFILPK (SEQ ID NO: 1457), QATQIKSWIDRLLVSED (SEQ ID NO: 1458), MGDINRNF (SEQ ID NO: 1459), FTTPMIGIPAGLLGGSYYLKRREEKGK (SEQ ID NO: 1460), VRCRL (SEQ ID NO: 1461), TSGLIIGENGLNGL (SEQ ID NO: 1462), SNSVQQG (SEQ ID NO: 1463), APASPGRRPG (SEQ ID NO: 1464), GTFLGQKCAAATAS (SEQ ID NO: 1465), CPRYPFVDVGPAGPWRARWRVGS (SEQ ID NO: 1466), PRWPTGAGRHR (SEQ ID NO: 1467), FLAPARPDLQAQRQALAQ (SEQ ID NO: 1468), QSVHPLPAETPVADVI (SEQ ID NO: 1469), LSGRLAGRR (SEQ ID NO: 1470), DAPCFDDQFGDLKCQMC (SEQ ID NO: 1471), RGMFVPFHDVDCVQ (SEQ ID NO: 1472), YVANYTITQFGRDFDDRLAVAIHFA (SEQ ID NO: 1473), PTTPPPTTPPEIPTGGTVIST (SEQ ID NO: 1474), TVIST (SEQ ID NO: 1475), TDPQATAAPRRRTSPR (SEQ ID NO: 1476), PDEDIRRRAILPPAGPCRPMSPE (SEQ ID NO: 1477), GKQSRAHGPVASRREFRRKSG (SEQ ID NO: 1478), ATLIPRKA (SEQ ID NO: 1479), DQLCVEYPARVSTG (SEQ ID NO: 1480), VLRVATAVGEVPTGL (SEQ ID NO: 1481), PNRRSRPR (SEQ ID NO: 1482), PAHQRLRIDQRLVADRDMVQDYES (SEQ ID NO: 1483), TNAESMALAFRGRVHMSVNIAGLT (SEQ ID NO: 1484), TVIVAPMHSGV (SEQ ID NO: 1485), MRFGSLALVAYDSAIKHSWPRPSSVRRLRM (SEQ ID NO: 1486), EIIPISPTRRCEMHTMSSAEYRGL (SEQ ID NO: 1487), TCRGAGMH (SEQ ID NO: 1488), ADPHPTTGI (SEQ ID NO: 1489), TALTTVGVSGARLITYCVGVEDI (SEQ ID NO: 1490), RRGK (SEQGLSRR (SEQ ID NO: 1491), LWPVA (SEQ ID NO: 1492), RKLSLASGFALWRRSLV (SEQ ID NO: 1493), PTLWLACL (SEQ ID NO: 1494), LAVLMGYIGYRGWSGKRHINRQ (SEQ ID NO: 1495), AKRVLSLAVAPHRRQPVQGT (SEQ ID NO: 1496), ARNHAVIPAG (SEQ ID NO: 1497), MIPLAGDPVSSHRTVEFGVLGTYLVSGGSL (SEQ ID NO: 1498), HRTVEFGVLGTYLVSGGSL (SEQ ID NO: 1499), GVAREDPLEPDPLAPIIDDSR (SEQ ID NO: 1500), PDPAR (SEQ ID NO: 1501), DLIRPLYSMSAPSVA (SEQ ID NO: 1502), ALSVMLGNIPLVVPNANQL (SEQ ID NO: 1503), IRSGISAAYARPLR (SEQ ID NO: 1504), RADARAK (SEQ ID NO: 1505), SSGRAGVKCRRPTGR (SEQ ID NO: 1506), GRAGVKCRRPTGR (SEQ ID NO: 1507), LNWPFTGR (SEQ ID NO: 1508), LSGRLAGRR (SEQ ID NO: 1509), APAARAAL (SEQ ID NO: 1510), KSSGSSASASSTAGGSSSK (SEQ ID NO: 1511), KSGATSAASGAKSGASS (SEQ ID NO: 1512), AKREDTVAAQIGANILNLIQ (SEQ ID NO: 1513), LGVGTFVGKVLIKNQQKQKSKKKAQ (SEQ ID NO: 1514), ANSQNSLFSNRSSFKSIFDKKSNITTNATTPNSNIIN (SEQ ID NO: 1515), FLGNSQYFTRK (SEQ ID NO: 1516), FQGFFDVAVNKWWEEHNKAKLWKNVKGKFLEGEGEEEDDE (SEQ ID NO: 1517), GVNKWWEEHNKAKLWKNVKGKFLEGEGEEEDDE (SEQ ID NO: 1518), LHVIRPRPELSELKFPITKILKVNKQGLKK (SEQ ID NO: 1519), DALLRLA (SEQ ID NO: 1520), PQAISSVQQNA (SEQ ID NO: 1521), DHITLDDYEIHDGFNFELYYG (SEQ ID NO: 1522), SKFELVNYASGCSCGADCKCASETECKCASKK (SEQ ID NO: 1523), PAPAPSAPAPAPEQPEQPA (SEQ ID NO: 1524), GIWMARNYFHRSSIRKVYVESDKEYERVHPMQKIQYEGNYKSQ (SEQ ID NO: 1525), GYFEPGKRD (SEQ ID NO: 1526), GVGIGFIMMGVVGYAVKLVHIPIRYLIV (SEQ ID NO: 1527), VSILLYLSATIILPNVLRLLVARAIIVRV (SEQ ID NO: 1528), SRFRNGV (SEQ ID NO: 1529), YNLSIYIYFLHTITIAGLITLPFII (SEQ ID NO: 1530), YFWWYWVQDCIPYKNNEVWLELSNNMK (SEQ ID NO: 1531), FETGFGDGYYMSLWGLNEKDEVCKVVIPFINPELID (SEQ ID NO: 1532), TLNYKKMFFSVIFLLGLNYLICNSPLFFKQIEF (SEQ ID NO: 1533), PLARATEVVATLFIICSLLLYLTR (SEQ ID NO: 1534), DEEALEMGANLYAQ-

FAIDFLNSKK (SEQ ID NO: 1535), DEERYSDSYFLKEKVFYLILALFLILFHQKYLYFLEIITI (SEQ ID NO: 1536), NALMLREMQLAKNIKVEVTDVLSNKKYC (SEQ ID NO: 1537), QVIVKIL (SEQ ID NO: 1538), KKMFSLIRKVNWIFFILFIVLDLTNVFPLIRTILFAILSRQ (SEQ ID NO: 1539), KALVISVFAIVFSIIFVKFFYWRDKK (SEQ ID NO: 1540), FFSVIFLFGLNYLICNSPLFNILR (SEQ ID NO: 1541), KKFKIFVIINWFYHKYIILNFEENF (SEQ ID NO: 1542), ELFFTILSDCNELFLLHLLQQPLFYIKKGK (SEQ ID NO: 1543), DIANNILNSVSERLIIA (SEQ ID NO: 1544), MPKRHYYKLEAKALQFGLPFAYSPIQLLK (SEQ ID NO: 1545), ASNTPRFVRLTLFNFYSKIWNVTHLFLFNNL (SEQ ID NO: 1546), LLALNMNEDTYYFELFFIFDNQNKKWLIFDLKERG (SEQ ID NO: 1547), PETKGKVSAFVFGIVVANVIAVVYILYMLREIGIIQ (SEQ ID NO: 1548), ASLSTMTFKVMELKELIILLCGLTMLMIQTEFV (SEQ ID NO: 1549), QWIVAKREIRMHIYCHISVIHVIIFFG (SEQ ID NO: 1550), KNTHAYLRVLRLSSLILSYQASVYPLFAYLCQQKDY (SEQ ID NO: 1551), LILSYQASVYPLFAYLCQQKDY (SEQ ID NO: 1552), QRMYWFKRGFETGDFSAGDTFAELK (SEQ ID NO: 1553), LLASHPERLSLGVFFVYRVLHLLLENT (SEQ ID NO: 1554), DFPPLSFFRRRFHAYTAPIDNFFGANPF (SEQ ID NO: 1555), VVFGGGDRLV (SEQ ID NO: 1556), YGKESDP (SEQ ID NO: 1557), TVEELDKAFTWGAAAALAIGVIAINVGLAAGYCYNNNDVF (SEQ ID NO: 1558), KMRAGQVVFIYKLILVLLFYVLQKLFDLKKGCF (SEQ ID NO: 1559), NTNDLLQAFELMGLGMAGVFIVLGILYIVAELLIKIFPVNN (SEQ ID NO: 1560), GGHKQLVIEPLVSQ (SEQ ID NO: 1561), KKEKLLTAIRLQHRAEIRGYFTIFFLFFRI (SEQ ID NO: 1562), GNVHPESDFHNLIQFIKTFLYFTIFFKYFL (SEQ ID NO: 1563), HPFLTGTGCPLFLIFRLFFVKAYFSFTVF (SEQ ID NO: 1564), IIIILPKIYLVCKTV (SEQ ID NO: 1565), and ALALLKQDLLNFEGRGRIITSTYLQFNEGCVP (SEQ ID NO: 1566).

5. The chimeric construct of claim 3, wherein said targeting peptide is linked to said antimicrobial peptide via a peptide linkage.

6. The chimeric construct of claim 5, wherein said construct is a fusion protein.

7. The chimeric construct of claim 5, wherein said targeting peptide is attached to said effector by a peptide linker comprising an amino acid sequence selected from the group consisting of AAA (SEQ ID NO:3215), GGG (SEQ ID NO:3216), GGGG (SEQ ID NO:3217), SGG (SEQ ID NO:3218), GGSGGS (SEQ ID NO:3219), SAT (SEQ ID NO:3220), PYP (SEQ ID NO:3221), PSPSP (SEQ ID NO:3222), ASA (SEQ ID NO:3223), ASASA (SEQ ID NO:3224), PSPSP (SEQ ID NO:3225), KKKK (SEQ ID NO:3226), RRRR (SEQ ID NO:3227), GGGGS (SEQ ID NO:3228), GGGGS GGGGS (SEQ ID NO:3229), GGGGS GGGGS GGGGS (SEQ ID NO:3230), GGGGS GGGGS GGGGS GGGGS (SEQ ID NO:3231), GGGGS GGGGS GGGGS GGGGS GGGGS (SEQ ID NO:3232), and GGGGS GGGGS GGGGS GGGGS GGGGS GGGGS (SEQ ID NO:3233).

8. The chimeric construct of claim 1, wherein said targeting peptide is chemically conjugated to said effector.

9. The chimeric construct of claim 8, wherein said targeting peptide is chemically conjugated to said effector via a linker.

10. The chimeric construct of claim 8, wherein said targeting peptide is chemically conjugated to said effector via a linker comprising a polyethylene glycol (PEG).

11. The chimeric construct of claim 8, wherein said targeting peptide is chemically conjugated to said effector via a non-peptide linker selected from the group consisting of 2-nitrobenzene, O-nitrobenzyl, nitropyridyl disulfide, fioleoylphosphatidylethanolamine (DOPE), S-acetylmercaptosuccinic acid, 1,4,7,10-tetraazacyclododecane-1,4,7,10-tetracetic acid (DOTA), β-glucuronide, poly(alkylacrylic acid), 2,5-bis(hexyloxy)-1,4-bis[2,5-bis(hexyloxy)-4-formyl-phenylenevinylene]benzene, a disulfide linkage, poly(amidoamine) dendrimers, and a hydrazone linker.

12. The chimeric construct of claim 1, wherein said targeting peptide is linked directly to said effector.

13. The chimeric construct of claim 1, wherein said construct bears one or more protecting groups.

14. The chimeric construct of claim 1, wherein said construct is functionalized with a polymer to increase serum halflife.

15. A pharmaceutical composition comprising a chimeric construct of claim 1 in a pharmaceutically acceptable carrier.

16. The composition of claim 15, wherein said composition is formulated for administration by a modality selected from the group consisting of intraperitoneal administration, topical administration, oral administration, inhalation administration, transdermal administration, subdermal depot administration, and rectal administration.

17. The chimeric composition of claim 1 or 2, wherein said effector comprises a photosensitizing agent.

18. The composition of claim 17, wherein said photosensitizing agent is an agent selected from the group consisting of a porphyrinic macrocycle, a porphyrin, a chlorine, a crown ether, an acridine, an azine, a phthalocyanine, a cyanine, a cucumin, a psoralen, and a perylenequinonoid.

* * * * *